United States Patent
Sukackaite et al.

(10) Patent No.: US 11,618,891 B2
(45) Date of Patent: Apr. 4, 2023

(54) THERMOPHILIC DNA POLYMERASE MUTANTS

(71) Applicant: Thermo Fisher Scientific Baltics UAB, Carlsbad, CA (US)

(72) Inventors: Rasa Sukackaite, Vilnius (LT); Skaiste Valinskyte, Vilnius (LT)

(73) Assignee: Thermo Fisher Scientific Baltics UAB, Vilnius (LT)

(*) Notice: Subject to any disclaimer, the term of this patent is extended or adjusted under 35 U.S.C. 154(b) by 30 days.

(21) Appl. No.: 16/623,332

(22) PCT Filed: Jun. 25, 2018

(86) PCT No.: PCT/EP2018/066896
§ 371 (c)(1),
(2) Date: Dec. 16, 2019

(87) PCT Pub. No.: WO2019/002178
PCT Pub. Date: Jan. 3, 2019

(65) Prior Publication Data
US 2021/0147817 A1 May 20, 2021

Related U.S. Application Data

(60) Provisional application No. 62/524,730, filed on Jun. 26, 2017.

(51) Int. Cl.
*C12N 9/12* (2006.01)

(52) U.S. Cl.
CPC .... *C12N 9/1252* (2013.01); *C12Y 207/07007* (2013.01)

(58) Field of Classification Search
None
See application file for complete search history.

(56) References Cited

U.S. PATENT DOCUMENTS

| | | | |
|---|---|---|---|
| 5,489,523 A | 2/1996 | Mathur | |
| 6,627,424 B1 * | 9/2003 | Wang | C12Y 207/07049 435/194 |
| 7,074,556 B2 | 7/2006 | Li et al. | |
| 7,541,170 B2 | 6/2009 | Wang et al. | |
| 7,560,260 B2 | 7/2009 | Vander et al. | |
| 7,919,296 B2 | 4/2011 | Wang | |
| 8,367,376 B2 | 2/2013 | Vander et al. | |
| 8,435,775 B2 | 5/2013 | Holliger et al. | |
| 8,481,685 B2 * | 7/2013 | Bourn | C12N 9/1252 530/387.3 |
| 8,557,554 B2 | 10/2013 | Connolly et al. | |
| 8,697,410 B2 | 4/2014 | Cheng et al. | |
| 8,859,205 B2 | 10/2014 | Gong et al. | |
| 8,916,352 B2 | 12/2014 | Cheng | |
| 9,023,633 B2 | 5/2015 | Faurholm et al. | |
| 9,145,550 B2 | 9/2015 | Vander et al. | |
| 2003/0180741 A1 | 9/2003 | Hogrefe et al. | |
| 2011/0086406 A1 | 4/2011 | Martin et al. | |
| 2013/0089895 A1 | 4/2013 | Martin et al. | |
| 2013/0164817 A1 | 6/2013 | Martin et al. | |
| 2014/0099644 A1 | 4/2014 | Bornarth et al. | |
| 2015/0044683 A1 | 2/2015 | Park et al. | |

FOREIGN PATENT DOCUMENTS

| | | |
|---|---|---|
| EP | 0592035 A2 | 4/1994 |
| EP | 2902488 A1 | 8/2015 |
| JP | H1175847 A | 3/1999 |
| JP | 2008113604 A | 5/2008 |
| WO | WO-2003060144 A2 | 7/2003 |
| WO | WO-2004011605 A2 | 2/2004 |
| WO | WO-2004087868 A2 | 10/2004 |
| WO | WO-2007016702 A2 | 2/2007 |
| WO | WO-2010080910 A1 | 7/2010 |
| WO | WO-2012115464 A2 | 8/2012 |
| WO | WO-2012177695 A2 | 12/2012 |
| WO | WO-2015061714 A1 | 4/2015 |
| WO | WO-2017121836 A1 | 7/2017 |

OTHER PUBLICATIONS

Chica et al. Curr Opin Biotechnol. Aug. 2005;16(4):378-84. (Year: 2005).*
Singh et al. Curr Protein Pept Sci. 2017, 18, 1-11 (Year: 2017).*
Bornscheuer et al. Curr Protoc Protein Sci. Nov. 2011;Chapter 26:Unit26.7. (Year: 2011).*
Li et al. Biotechnol Bioeng. Jul. 2014;111(7):1273-87. Epub May 6, 2014. (Year: 2014).*
Accession P39476. Feb. 1, 1995 (Year: 1995).*
Advantages Of immunoglobulin F(ab) and F(ab')2 fragments 1998.
Anonymous, REFSEQ:WP 013143881, May 26, 2013.
Baumann et al., "Solution structure and DNA-binding properties of a thermostable protein from the archaean Sulfolobus solfataricus", Nature Structural & Molecular Biology, vol. 1, 1994, pp. 808-819.
Cann, "Functional interactions of a homolog of proliferating cell nuclear antigen with DNA polymerases in Archaea", Journal of bacteriology, vol. 181, No. 21, Nov. 1999, pp. 6591-6599.
Choli, "Isolation, characterization and microsequence analysis of a small basic methylated DNA-binding protein from the Archaebacterium, Sulfolobus solfataricus", Biochimica et Biophysica Acta (BBA), vol. 950, No. 2, Jul. 13, 1988, pp. 193-203.
Daiss, et al., "Topographical characterization of the DNA polymerase from Thermus aquaticus Defining groups of inhibitor mAbs by epitope mapping and functional analysis using surface plasmon resonance", Journal of Immunological Methods, vol. 183, No. 1, 1995, 15-26.

(Continued)

*Primary Examiner* — Christian L Fronda
(74) *Attorney, Agent, or Firm* — Klarquist Sparkman, LLP

(57) ABSTRACT

This disclosure relates to thermophilic family B DNA polymerases comprising a neutral amino acid residue at a certain position near the C-terminus of the catalytic domain, which corresponds to a position occupied by a basic amino acid residue in wild-type Pfu polymerase. The thermophilic family B DNA polymerases provided herein also comprise an N-terminal domain comprising a uracil-binding pocket that has been modified to reduce template uracil binding. Related uses, methods, and compositions are also provided. In some embodiments, the polymerases comprise a 3'-5' exonuclease domain and/or a sequence non-specific dsDNA binding domain.

19 Claims, 16 Drawing Sheets

Specification includes a Sequence Listing.

(56) References Cited

OTHER PUBLICATIONS

De Felice et al "Two DNA polymerase sliding clamps from the thermophilic archaeon Sulfolobus solfataricus", Journal of Molecular Biology, vol. 291, No. 1, Aug. 1999, pp. 47-57.
Firbank et al "Uracil Recognition in Archaeal DNA Polymerases Captured by X-ray Crystallography", Journal of Molecular Biology, vol. 381, No. 3, pp. 529-239.
Gao et al., "The crystal structure of the hyperthermophile chromosomal protein Sso7d bound to DNA", Nature Structural Biology, vol. 5, No. 9, Nature America Inc., Sep. 1998, pp. 782-786.
Hardy C. et al., "Biochemical characterization of DNA-binding proteins from Pyrobaculum aerophilum and Aeropyrum pernix", Extremophiles: Life Under Extreme Conditions, vol. 12, No. 2, Mar. 2008, pp. 235-246.
Kellogg et al., "TaqStart Antibody: "Hot Start" PCR Facilitated by a Neutralizing Monoclonal Antibody Directed Against Taq DNA Polymerase", Bio techniques, vol. 16, No. 6, BPA international, 1994; pp. 1134-1137.
Kennedy, et al., "The Mechanistic Architecture of the Thermostable Pyrococcus Furiosus Family B DNA Polymerase Motif A and its Interaction with dNTP Substrate", NIH Public Access Author Manuscript, Biochemistry; vol. 48, No. 47, Dec. 2009, pp. 1161-11168.
Mizuguchi, H et al., "Characterization and Application to Hot Start PCR of Neutralizing Monoclonal Antibodies against KOD DNA Polymerase", Journal of Biochemistry, vol. 126, No. 4, 1999, pp. 762-768.

NCBI cd05779: DNA_poiB_epsilon_exo Oct. 1, 2007.
Ngo, et al., "The Protein Folding Problem and Tertiary Structure Prediction", Merz et al. (ed.), Birkhauser Boston MA 1994, pp. 433 and 492-495.
PCT/EP2017/050631, "Partial International Search Report", dated Mar. 30, 2017, 1 Page.
PCT/EP2017/050631, Search Report and Written Opinion, dated May 12, 2017, 15 pages.
PCT/EP2017/050648, "International Search Report", dated Apr. 11, 2017, 6 Pages.
PCT/EP2018/066896, Search Report and Written Opinion, dated Aug. 10, 2018, pp. 1-13.
Rothwell, et al., "Structure and Mechanism of DNAPolymerases", Advances in Protein Chemistry, vol. 71, 2005, pp. 401-440.
Sandman et al., Gene, vol. 150, 1994, pp. 207-208.
Scalice, et al., "Monoclonal antibodies prepared against the DNA polymerase from Thermus aquaticus are potent inhibitors of enzyme activity", Journal of Immunological Methods, vol. 172, No. 2, 1994, 147-163.
Starich et al., "NMR structure of HMfB from the hyperthermophile, Methanothermus fervidus, confirms that this archaeal protein is a histone", vol. 255, No. 1, Jan. 1996, pp. 187-203.
Tubeleviciute et al., "Compartmentalized self-replication(CSR) selection of Thermococcus litoralis Sh1 B DNA polymerase for diminisheduracil binding", Protein Engineering, Design and Selection, vol. 23, No. 8, May 31, 2010, pp. 589-597.

* cited by examiner

```
Tli     MILDTDYITKDGKPIIRIFKKENGEFKIELDPHFQPYIYALLKDDSAIEEIKAIKGERHG
Tsp9N7  MILDTDYITENGKPVIRVFKKENGEFKIEYDRTFEPYFYALLKDDSAIEDVKKVTAKRHG
Tgo     MILDTDYITEDGKPVIRIFKKENGEFKIDYDRNFEPYIYALLKDDSAIEDVKKITAERHG
Tko     MILDTDYITEDGKPVIRIFKKENGEFKIEYDRTFEPYFYALLKDDSAIEEVKKITAERHG
Pfu     MILDVDYITEEGKPVIRLFKKENGKFKIEHDRTFRPYIYALLRDDSKIEEVKKITGERHG
DV      MILDADYITEDGKPIIRIFKKENGEFKVEYDRNFRPYIYALLKDDSQIDEVRKITAERHG
                                                       %

Tli     KTVRVLDAVKVRKKFLGREVEVWKLIFEHPQDVPAMRGKIREHPAVVDIYEYDIPFAKRY
Tsp9N7  TVVKVKRAEKVQKKFLGRPIEVWKLYFNHPQDVPAIRDRIRAHPAVVDIYEYDIPFAKRY
Tgo     TTVRVVRAEKVKKKFLGRPIEVWKLYFTHPQDVPAIRDKIKEHPAVVDIYEYDIPFAKRY
Tko     TVVTVKRVEKVQKKFLGRPVEVWKLYFTHPQDVPAIRDKIREHPAVIDIYEYDIPFAKRY
Pfu     KIVRIVDVEKVEKKFLGKPITVWKLYLEHPQDVPTIREKVREHPAVVDIFEYDIPFAKRY
DV      KIVRIIDAEKVRKKFLGRPIEVWRLYFEHPQDVPAIRDKIREHSAVIDIFEYDIPFAKRY

Tli     LIDKGLIPMEGDEELKLLAFDIETFYHEGDEFGKGEIIMISYADEEEARVITWKNIDLPY
Tsp9N7  LIDKGLIPMEGDEELTMLAFDIETLYHEGEEFGTGPILMISYADGSEARVITWKKIDLPY
Tgo     LIDKGLIPMEGDEELKMLAFDIETLYHEGEEFAEGPILMISYADEEGARVITWKNIDLPY
Tko     LIDKGLVPMEGDEELKMLAFDIETLYHEGEEFAEGPILMISYADEEGARVITWKNVDLPY
Pfu     LIDKGLIPMEGEEELKILAFDIETLYHEGEEFGKGPIIMISYADENEAKVITWKNIDLPY
DV      LIDKGLIPMEGDEELKLLAFDIETLYHEGEEFAKGPIIMISYADEEEAKVITWKKIDLPY

Tli     VDVVSNEREMIKRFVQVVKEKDPDVIITYNGDNFDLPYLIKRAEKLGVRLVLGRDKEHPE
Tsp9N7  VDVVSTEKEMIKRFLRVVREKDPDVLITYNGDNFDFAYLKKRCEELGIKFTLGRDG--SE
Tgo     VDVVSTEKEMIKRFLKVVKEKDPDVLITYNGDNFDFAYLKKRSEKLGVKFILGREG--SE
Tko     VDVVSTEREMIKRFLRVVKEKDPDVLITYNGDNFDFAYLKKRCEKLGINFALGRDG--SE
Pfu     VEVVSSEREMIKRFLRIIREKDPDIIVTYNGDSFDFPYLAKRAEKLGIKLTIGRDG--SE
DV      VEVVSSEREMIKRFLKVIREKDPDVIITYNGDSFDLPYLVKRAEKLGIKLPLGRDG--SE

Tli     PKIQRMGDSFAVEIKGRIHFDLFPVVRRTINLPTYTLEAVYEAVLGKTKSKLGAEEIAAI
Tsp9N7  PKIQRMGDRFAVEVKGRIHFDLYPVIRRTINLPTYTLEAVYEAVFGKPKEKVYAEEIAQA
Tgo     PKIQRMGDRFAVEVKGRIHFDLYPVIRRTINLPTYTLEAVYEAIFGQPKEKVYAEEIAQA
Tko     PKIQRMGDRFAVEVKGRIHFDLYPVIRRTINLPTYTLEAVYEAVFGQPKEKVYAEEITTA
Pfu     PKMQRIGDMTAVEVKGRIHFDLYHVITRTINLPTYTLEAVYEAIFGKPKEKVYADEIAKA
DV      PKMQRLGDMTAVEIKGRIHFDLYHVIRRTINLPTYTLEAVYEAIFGKPKEKVYAHEIAEA

Tli     WETEESMKKLAQYSMEDARATYELGKEFFPMEAELAKLIGQSVWDVSRSSTGNLVEWYLL
Tsp9N7  WESGEGLERVARYSMEDAKVTYELGREFFPMEAQLSRLIGQSLWDVSRSSTGNLVEWFLL
Tgo     WETGEGLERVARYSMEDAKVTYELGKEFFPMEAQLSRLVGQSLWDVSRSSTGNLVEWFLL
Tko     WETGENLERVARYSMEDAKVTYELGKEFLPMEAQLSRLIGQSLWDVSRSSTGNLVEWFLL
Pfu     WESGENLERVAKYSMEDAKATYELGKEFLPMEIQLSRLVGQPLWDVSRSSTGNLVEWFLL
DV      WETGKGLERVAKYSMEDAKVTYELGREFFPMEAQLSRLVGQPLWDVSRSSTGNLVEWYLL

Tli     RVAYARNELAPNKPDEEEYKRRLRTTYLGGYVKEPEKGLWENIIYLDFRSLYPSIIVTHN
Tsp9N7  RKAYKRNELAPNKPDERELARR-RGGYAGGYVKEPERGLWDNIVYLDFRSLYPSIIITHN
Tgo     RKAYERNELAPNKPDERELARR-RESYAGGYVKEPERGLWENIVYLDFRSLYPSIIITHN
Tko     RKAYERNELAPNKPDEKELARR-RQSYEGGYVKEPERGLWENIVYLDFRSLYPSIIITHN
Pfu     RKAYERNEVAPNKPSEEEYQRRLRESYTGGFVKEPEKGLWENIVYLDFRALYPSIIITHN
DV      RKAYERNELAPNKPDEREYERRLRESYAGGYVKEPEKGLWEGLVSLDFRSLYPSIIITHN
                                                        *
```

*FIG. 11A*

```
Tli      VSPDTLEKEGCKNYDVAPIVGYRFCKDFPGFIPSILGDLIAMRQDIKKKMKSTIDPIEKK
Tsp9N7   VSPDTLNREGCKEYDVAPEVGHKFCKDFPGFIPSLLGDLLEERQKIKRKMKATVDPLEKK
Tgo      VSPDTLNREGCEEYDVAPQVGHKFCKDFPGFIPSLLGDLLEERQKVKKKMKATIDPIEKK
Tko      VSPDTLNREGCKEYDVAPQVGHRFCKDFPGFIPSLLGDLLEERQKIKKKMKATIDPIERK
Pfu      VSPDTLNLEGCKNYDIAPQVGHKFCKDIPGFIPSLLGHLLEERQKIKTKMKETQDPIEKI
DV       VSPDTLNREGCREYDVAPEVGHKFCKDFPGFIPSLLKRLLDERQEIKRKMKASKDPIEKK

Tli      MLDYRQRAIKLLANSYYGYMGYPKARWYSKECAESVTAWGRHYIEMTIREIEEKFGFKVL
Tsp9N7   LLDYRQRAIKILANSFYGYYGYAKARWYCKECAESVTAWGREYIEMVIRELEEKFGFKVL
Tgo      LLDYRQRAIKILANSFYGYYGYAKARWYCKECAESVTAWGRQYIETTIREIEEKFGFKVL
Tko      LLDYRQRAIKILANSYYGYYGYARARWYCKECAESVTAWGREYITMTIKEIEEKYGFKVI
Pfu      LLDYRQKAIKLLANSFYGYYGYAKARWYCKECAESVTAWGRKYIELVWKELEEKFGFKVL
DV       MLDYRQRAIKILANSYYGYYGYAKARWYCKECAESVTAWGREYIEFVRKELEEKFGFKVL

Tli      YADTDGFYATIPGEKPELIKKKAKEFLNYINSKLPGLLELEYEGFYLRGFFVTKKRYAVI
Tsp9N7   YADTDGLHATIPGADAETVKKKAKEFLKYINPKLPGLLELEYEGFYVRGFFVTKKKYAVI
Tgo      YADTDGFFATIPGADAETVKKKAKEFLDYINAKLPGLLELEYEGFYKRGFFVTKKKYAVI
Tko      YSDTDGFFATIPGADAETVKKKAMEFLKYINAKLPGALELEYEGFYKRGFFVTKKKYAVI
Pfu      YIDTDGLYATIPGGESEEIKKKALEFVKYINSKLPGLLELEYEGFYKRGFFVTKKRYAVI
DV       YIDTDGLYATIPGAKPEEIKKKALEFVDYINAKLPGLLELEYEGFYVRGFFVTKKKYALI

Tli      DEEGRITTRGLEVVRRDWSEIAKETQAKVLEAILKEGSVEKAVEVVRDVVEKIAKYRVPL
Tsp9N7   DEEGKITTRGLEIVRRDWSEIAKETQARVLEAILKHGDVEEAVRIVKEVTEKLSKYEVPP
Tgo      DEEDKITTRGLEIVRRDWSEIAKETQARVLEAILKHGDVEEAVRIVKEVTEKLSKYEVPP
Tko      DEEGKITTRGLEIVRRDWSEIAKETQARVLEALLKDGDVEKAVRIVKEVTEKLSKYEVPP
Pfu      DEEGKVITRGLEIVRRDWSEIAKETQARVLETILKHGDVEEAVRIVKEVIQKLANYEIPP
DV       DEEGKIITRGLEIVRRDWSEIAKETQAKVLEAILKHGNVEEAVKIVKEVTEKLSKYEIPP

Tli      EKLVIHEQITRDLKDYKAIGPHVAIAKRLAARGIKVKPGTIISYIVLKGSGKISDRVILL
Tsp9N7   EKLVIHEQITRDLRDYKATGPHVAVAKRLAARGVKIRPGTVISYIVLKGSGRIGDRAIPA
Tgo      EKLVIYEQITRDLKDYKATGPHVAVAKRLAARGIKIRPGTVISYIVLKGSGRIGDRAIPF
Tko      EKLVIHEQITRDLKDYKATGPHVAVAKRLAARGVKIRPGTVISYIVLKGSGRIGDRAIPF
Pfu      EKLAIYEQITRPLHEYKAIGPHVAVAKKLAAKGVKIKPGMVIGYIVLRGDGPISNRAILA
DV       EKLVIYEQITRPLHEYKAIGPHVAVAKRLAARGVKVRPGMVIGYIVLRGDGPISKRAILA

Tli      TEYDPRKHKYDPDYYIENQVLPAVLRILEAFGYRKEDLRYQSSXQTGLDAWLKR-------
Tsp9N7   DEFDPTKHRYDAEYYIENQVLPAVERILKAFGYRKEDLRYQKTXQVGLGAWLKVKGKK---
Tgo      DEFDPAKHKYDAEYYIENQVLPAVERILRAFGYRKEDLRYQKTXQVGLGAWLKPKT-----
Tko      DEFDPTKHKYDAEYYIENQVLPAVERILRAFGYRKEDLRYQKTXQVGLSAWLKPKGT----
Pfu      EEYDPKKHKYDAEYYIENQVLPAVLRILEGFGYRKEDLRYQKTXQVGLTSWLNIKKS----
DV       EEFDLRKHKYDAEYYIENQVLPAVLRILEAFGYRKEDLRWQKTXQTGLTAWLNIKKK----
                                                       #
Tli      SEQ ID NO: 31
Tsp9N7   SEQ ID NO: 49
Tgo      SEQ ID NO: 39
Tko      SEQ ID NO: 43
Pfu      SEQ ID NO: 2
DV       SEQ ID NO: 23
```

FIG. 11B

```
Tli       TYLGGYVKEPEKGLWENIIYLDFRSLYPSIIVTHNVSPDTLEKEGCKNYDVAPIVGYRFC
Tsp9N7    GYAGGYVKEPERGLWDNIVYLDFRSLYPSIIITHNVSPDTLNREGCKEYDVAPEVGHKFC
Tgo       SYAGGYVKEPERGLWENIVYLDFRSLYPSIIITHNVSPDTLNREGCEEYDVAPQVGHKFC
Tko       SYEGGYVKEPERGLWENIVYLDFRSLYPSIIITHNVSPDTLNREGCKEYDVAPQVGHRFC
Pfu       SYTGGFVKEPEKGLWENIVYLDFRALYPSIIITHNVSPDTLNLEGCKNYDIAPQVGHKFC
DV        SYAGGYVKEPEKGLWEGLVSLDFRSLYPSIIITHNVSPDTLNREGCREYDVAPEVGHKFC
                                    *

Tli       KDFPGFIPSILGDLIAMRQDIKKKMKSTIDPIEKKMLDYRQRAIKLLANSYYGYMGYPKA
Tsp9N7    KDFPGFIPSLLGDLLEERQKIRKMKATVDPLEKKLLDYRQRAIKILANSFYGYYGYAKA
Tgo       KDFPGFIPSLLGDLLEERQKVKKKMKATIDPIEKKLLDYRQRAIKILANSFYGYYGYAKA
Tko       KDFPGFIPSLLGDLLEERQKIKKKMKATIDPIERKLLDYRQRAIKILANSYYGYYGYARA
Pfu       KDIPGFIPSLLGHLLEERQKIKTKMKETQDPIEKILLDYRQKAIKLLANSFYGYYGYAKA
DV        KDFPGFIPSLLKRLLDERQEIKRKMKASKDPIEKKMLDYRQRAIKILANSYYGYYGYAKA

Tli       RWYSKECAESVTAWGRHYIEMTIREIEEKFGFKVLYADTDGFYATIPGEKPELIKKKAKE
Tsp9N7    RWYCKECAESVTAWGREYIEMVIRELEEKFGFKVLYADTDGLHATIPGADAETVKKKAKE
Tgo       RWYCKECAESVTAWGRQYIETTIREIEEKFGFKVLYADTDGFFATIPGADAETVKKKAKE
Tko       RWYCKECAESVTAWGREYITMTIKEIEEKYGFKVIYSDTDGFFATIPGADAETVKKKAME
Pfu       RWYCKECAESVTAWGRKYIELVWKELEEKFGFKVLYIDTDGLYATIPGGESEEIKKKALE
DV        RWYCKECAESVTAWGREYIEFVRKELEEKFGFKVLYIDTDGLYATIPGAKPEEIKKKALE

Tli       FLNYINSKLPGLLELEYEGFYLRGFFVTKKRYAVIDEEGRITTRGLEVVRRDWSEIAKET
Tsp9N7    FLKYINPKLPGLLELEYEGFYVRGFFVTKKKYAVIDEEGKITTRGLEIVRRDWSEIAKET
Tgo       FLDYINAKLPGLLELEYEGFYKRGFFVTKKKYAVIDEEDKITTRGLEIVRRDWSEIAKET
Tko       FLKYINAKLPGALELEYEGFYKRGFFVTKKKYAVIDEEGKITTRGLEIVRRDWSEIAKET
Pfu       FVKYINSKLPGLLELEYEGFYKRGFFVTKKRYAVIDEEGKVITRGLEIVRRDWSEIAKET
DV        FVDYINAKLPGLLELEYEGFYVRGFFVTKKKYALIDEEGKIITRGLEIVRRDWSEIAKET

Tli       QAKVLEAILKEGSVEKAVEVVRDVVEKIAKYRVPLEKLVIHEQITRDLKDYKAIGPHVAI
Tsp9N7    QARVLEAILKHGDVEEAVRIVKEVTEKLSKYEVPPEKLVIHEQITRDLRDYKATGPHVAV
Tgo       QARVLEAILKHGDVEEAVRIVKEVTEKLSKYEVPPEKLVIYEQITRDLKDYKATGPHVAV
Tko       QARVLEALLKDGDVEKAVRIVKEVTEKLSKYEVPPEKLVIHEQITRDLKDYKATGPHVAV
Pfu       QARVLETILKHGDVEEAVRIVKEVIQKLANYEIPPEKLAIYEQITRPLHEYKAIGPHVAV
DV        QAKVLEAILKHGNVEEAVKIVKEVTEKLSKYEIPPEKLVIYEQITRPLHEYKAIGPHVAV

Tli       AKRLAARGIKVKPGTIISYIVLKGSGKISDRVILLTEYDPRKHKYDPDYYIENQVLPAVL
Tsp9N7    AKRLAARGVKIRPGTVISYIVLKGSGRIGDRAIPADEFDPTKHRYDAEYYIENQVLPAVE
Tgo       AKRLAARGIKIRPGTVISYIVLKGSGRIGDRAIPFDEFDPAKHKYDAEYYIENQVLPAVE
Tko       AKRLAARGVKIRPGTVISYIVLKGSGRIGDRAIPFDEFDPTKHKYDAEYYIENQVLPAVE
Pfu       AKKLAAKGVKIKPGMVIGYIVLRGDGPISNRAILAEEYDPKKHKYDAEYYIENQVLPAVL
DV        AKRLAARGVKVRPGMVIGYIVLRGDGPISKRAILAEEFDLRKHKYDAEYYIENQVLPAVL

Tli       RILEAFGYRKEDLRYQSSXQTGL    SEQ ID NO: 33
Tsp9N7    RILKAFGYRKEDLRYQKTXQVGL    SEQ ID NO: 47
Tgo       RILRAFGYRKEDLRYQKTXQVGL    SEQ ID NO: 41
Tko       RILRAFGYRKEDLRYQKTXQVGL    SEQ ID NO: 45
Pfu       RILEGFGYRKEDLRYQKTXQVGL    SEQ ID NO: 7
DV        RILEAFGYRKEDLRWQKTXQTGL    SEQ ID NO: 25
                       #
```

*FIG. 12*

THERMOPHILIC DNA POLYMERASE MUTANTS

RELATED APPLICATIONS

This application is a 371 U.S. National Phase Application of PCT/EP2018/066896 filed Jun. 25, 2018, which claims priority to and the benefit of U.S. Provisional Patent Application Ser. No. 62/524,730 filed Jun. 26, 2017, which applications are incorporated herein by reference in their entirety.

SEQUENCE LISTING

The instant application contains a Sequence Listing which has been submitted electronically in ASCII format and is hereby incorporated by reference in its entirety. Said ASCII copy is entitled 9748-108598-01 Replacement Sequence Listing.txt and was created on Nov. 11, 2022 and is 854,295 bytes.

BACKGROUND OF THE DISCLOSURE

This disclosure relates to the field of thermophilic DNA polymerase mutants, including methods, uses, and compositions thereof.

Thermophilic DNA polymerases are commonly used in biotechnology and molecular biology applications, including nucleic acid synthesis techniques such as amplification (e.g., polymerase chain reaction, or PCR), which involves cycles of alternating denaturation and primer annealing and extension. Thermophilic DNA polymerases are resistant to inactivation by high temperatures and so are compatible with thermal denaturation steps. DNA polymerases comprise a catalytic domain that extends a 3' terminus of a DNA strand in a template-dependent manner. DNA polymerases can also comprise an exonuclease domain, such as a 3' to 5' exonuclease domain. Such an exonuclease domain can reduce the frequency of misincorporation by removing mismatched nucleotides from the 3' end of a nascent DNA strand. Certain artificial DNA polymerases further comprise a sequence non-specific double-stranded DNA (dsDNA) binding domain. The presence of this domain can improve performance of the enzyme with respect to various parameters, including processivity, sensitivity, and yield.

Nucleic acid amplification can permit rapid detection of a target nucleic acid sequence and/or provide sufficient quantities of a sample for further analysis or manipulation, such as sequencing, cloning, restriction digestion, hybridization, ligation, mutagenesis, recombination, etc. Two key parameters of amplification are sensitivity and yield. Improving the sensitivity reduces the minimum amount of a target needed to produce a detectable product. Improving the yield increases the amount of product that results from a reaction, or reduces the amount of time and/or reagents necessary to obtain a given amount of product.

Samples may be refractory to amplification or may decrease sensitivity and/or yield if they contain nucleic acid synthesis inhibitors, which may occur naturally in the sample or may be introduced during earlier sample processing steps. Examples of nucleic acid synthesis inhibitors include polyanions such as heparin or xylan; anionic detergents such as sodium dodecyl sulfate; and certain complex organic substances such as humic acid, collagen, heme and heme-containing proteins, bile salts, and the like. Thermophilic DNA polymerases with improved tolerance of such inhibitors would reduce the need for purification and other sample processing steps in advance of nucleic acid synthesis and reduce the frequency of unsatisfactory synthesis reactions.

Certain polymerases such as the family B polymerases, including *Pyrococcus furiosus* (Pfu) DNA polymerase (see Kennedy et al., "The Mechanistic Architecture of the Thermostable *Pyrococcus furiosus* Family B DNA Polymerase Motif A and its Interaction with dNTP Substrate," *Biochemistry* 2009 Dec. 1; 48(47): 11161-11168. doi:10.1021/bi9010122) and related polymerases, may benefit from mutations that increase yield and/or sensitivity. In some instances, an A408S mutation has been introduced into family B polymerases in order to improve accuracy (i.e., reduced error rate or increased fidelity), but with a detrimental impact on yield and/or sensitivity. It would be desirable to provide variants of family B polymerases that have improved yield and/or sensitivity. Further, coupled with an A408S mutation, such variants may have improved yield and/or sensitivity and also improved fidelity. It would also be desirable to provide variants of such polymerases with improved inhibitor resistance. Such polymerases could be suitable for use with a broader spectrum of samples and/or could reduce the need for preprocessing in advance of nucleic acid synthesis reactions in which high fidelity is desirable, such as for cloning, sequencing, gene construction, site-directed mutagenesis, etc.

A feature of archaeal family B DNA polymerases is the ability to recognize and bind uracil bases in template DNA during the amplification reaction. The uracil-binding pocket in nature reduces the accumulation of mutations caused by cytosine deamination to uracil and subsequent G-C base pair transitions to A-T during DNA replication. The uracil binding pocket recognizes and binds uracil bases in the template strand, stopping the polymerase. In PCR, the uracil-binding property of archaeal family B polymerases may be disadvantageous and result in decreased DNA amplification yields and lowered sensitivity. Even trace amounts of uracil may decrease DNA amplification yields and lower the sensitivity in simple PCR, high-fidelity PCR, and particularly in long-range PCR, where long elongation times are required. Furthermore, in certain diagnostic methods, qPCR, RT-qPCR, and end-point PCR may be performed using dNTP mixtures in which dTTP is partially or fully replaced by dUTP. Uracil-DNA glycosylase treatment and subsequent heating of the samples is used to degrade the DNA containing uracil and prevent carryover contamination, a primary concern in diagnostic laboratories. A thermostable archaeal family B DNA polymerase with improved yield and/or sensitivity and/or fidelity, and in which termplate uracil binding is diminished or abolished would therefore be highly desirable.

The uracil-binding pocket is located in the N-terminal domain of archaeal family B DNA polymerases and comprises amino acids from two conserved regions of the archaeal DNA polymerases: Region A and Region B, which are separated by a less conserved region. In the archaeal polymerase from *Pyrococcus furiosus*, Region A comprises amino acids 1-40 and Region B comprises amino acids 78-130. Uracil binding is mediated by relatively inflexible main-chain atoms, consistent with the sizeable difference (greater than 2 orders of magnitude) in binding affinity for uracil- and non-uracil-containing DNA. The pocket also contains a relatively high proportion of prolines, which may impart additional rigidity. The C5-C6 edge of the bound uracil packs against Pro90, Pro36 and Phe116. Packing above and below uracil are the side chains of Val93 and Pro36, and Ile114 and Arg119, respectively. These amino acids show a high level of conservation, approaching 100%, emphasizing their structural and functional importance (Firbank, 2008, *J. Mol. Biol.* 381: 529-539).

Archaeal family B DNA polymerases with substitutions at position Pro36 have been shown to have reduced affinity for uracil as compared to the wild-type polymerase. P36A mutant of Pfu DNA polymerase was able to extend primers beyond template strand uracil, yielding a mixture of truncated and full-length products (Firbank 2008). P36L mutant of Sh1B DNA polymerase was shown to amplify DNA in the presence of higher concentrations of dUTP compared with the wild-type enzyme, while P36H showed the highest resistance by performing PCR in the reaction mixtures where dTTP was completely replaced by dUTP (Tubeleviciute, 2010, *Protein Engineering Design & Selection* 23: 589-597).

Thus, there are needs for thermophilic DNA polymerases having increased inhibitor tolerance and/or the capability to provide increased yield and/or sensitivity and/or fidelity, and in which template uracil binding is diminished or abolished. Provided herein are polymerases and related methods and compositions that can solve these needs and/or provide other benefits.

In some embodiments, the present disclosure provides thermophilic DNA polymerase mutants and methods of nucleic acid synthesis using thermophilic DNA polymerase mutants. In some embodiments, a thermophilic DNA polymerase comprising a family B polymerase N-terminal domain comprising a uracil-binding pocket and a family B polymerase catalytic domain is provided, the family B polymerase N-terminal domain comprising a uracil-binding pocket having an amino acid sequence in which the position corresponding to position 36 of SEQ ID NO: 1 is any amino acid other than P, and the family B polymerase catalytic domain having an amino acid sequence in which the position corresponding to position 762 of SEQ ID NO: 1 is a neutral amino acid residue. In some embodiments, the position corresponding to position 36 of SEQ ID NO: 1 is selected from Q, N, H, S, T, Y, C, M, W, A, I, L, F, V, and G. In some embodiments, the position corresponding to position 36 of SEQ ID NO: 1 is H. In some embodiments, the position corresponding to position 762 of SEQ ID NO: 1 is selected from Q, N, H, S, T, Y, C, M, W, A, I, L, F, V, P, and G. In some embodiments, the position corresponding to position 762 of SEQ ID NO: 1 is selected from Q and N.

In some embodiments, the family B polymerase catalytic domain has at least 80%, 85%, 90%, 95%, 98%, 99%, or 100% identity to the family B polymerase catalytic domain sequence of a sequence selected from SEQ ID NOs: 6 to 10, 15 to 18, 25, 26, 33, 34, 37, 38, 41, 42, and 45 to 48, wherein X is the neutral amino acid residue and is selected from Q, N, H, S, T, Y, C, M, W, A, I, L, F, V, P, and G. In some embodiments, X is N or G.

In some embodiments, a thermophilic DNA polymerase is provided, wherein the family B polymerase N-terminal domain comprising a uracil-binding pocket has at least 80%, 85%, 90%, 95%, 98%, 99%, or 100% identity to the family B polymerase N-terminal domain comprising a uracil-binding pocket sequence of a sequence selected from SEQ ID NOs: 115 to 121 and 162 to 168, wherein $X^1$ is any amino acid other than P. In some embodiments, $X^1$ is selected from Q, N, H, S, T, Y, C, M, W, A, I, L, F, V, and G. In some embodiments, $X^1$ is H.

In some embodiments, a thermophilic DNA polymerase is provided, comprising a family B polymerase N-terminal domain comprising a uracil-binding pocket and a family B polymerase catalytic domain, wherein the amino acid residue at the position of the amino acid sequence that aligns to position 36 of SEQ ID NO: 1 is any amino acid other than P, and wherein the amino acid residue at the position of the amino acid sequence that aligns to position 762 of SEQ ID NO: 1 is a neutral amino acid residue. In some embodiments, the amino acid residue at the position of the amino acid sequence that aligns to position 36 of SEQ ID NO: 1 is selected from Q, N, H, S, T, Y, C, M, W, A, I, L, F, V, and G. In some embodiments, the amino acid residue at the position of the amino acid sequence that aligns to position 36 of SEQ ID NO: 1 is H. In some embodiments, the amino acid residue at the position of the amino acid sequence that aligns to position 762 of SEQ ID NO: 1 is selected from Q, N, H, S, T, Y, C, M, W, A, I, L, F, V, P, and G. in some embodiments, the amino acid residue at the position of the amino acid sequence that aligns to position 762 of SEQ ID NO: 1 is selected from Q and N.

In some embodiments, the family B polymerase catalytic domain has at least 80%, 85%, 90%, 95%, 98%, 99%, or 100% identity to SEQ ID NO: 6. In some embodiments, the family B polymerase N-terminal domain comprising a uracil-binding pocket has at least 80%, 85%, 90%, 95%, 98%, 99%, or 100% identity to a sequence selected from SEQ ID NOs: 115 to 121 and 162 to 168, wherein $X^1$ is any amino acid other than P. In some embodiments, $X^1$ is selected from Q, N, H, S, T, Y, C, M, W, A, I, L, F, V, and G. In some embodiments, $X^1$ is H.

In some embodiments, the amino acid residue at the position of the amino acid sequence that corresponds to position 408 of SEQ ID NO: 1 is a serine.

In some embodiments, the family B polymerase N-terminal domain comprising a uracil-binding pocket comprises a consecutive amino acid sequence of RHYIY (SEQ ID NO: 177), QHYIY (SEQ ID NO: 178), EHYIY (SEQ ID NO: 179), EHYFY (SEQ ID NO: 180), or RHYFY (SEQ ID NO: 181), and the family B polymerase catalytic domain comprises a consecutive amino acid sequence of WQKTX (SEQ ID NO: 182), XQTGL (SEQ ID NO: 183), KTXQT (SEQ ID NO: 184), YQKTX (SEQ ID NO: 185), XQVGL (SEQ ID NO: 186), KTXQV (SEQ ID NO: 187), YQSSX (SEQ ID NO: 188), XQTGL (SEQ ID NO: 183), SSXQT (SEQ ID NO: 189), TGRVX (SEQ ID NO: 190), XKSLL (SEQ ID NO: 191), RVXKS (SEQ ID NO: 192), TGRSX (SEQ ID NO: 193), XRTLL (SEQ ID NO: 194), or RSXRT (SEQ ID NO: 195);

wherein X is a neutral amino acid residue; and wherein X is within 20 residues of the C-terminus of the family B polymerase catalytic domain. In some embodiments, the family B polymerase catalytic domain is a subfamily B3 polymerase domain. In some embodiments, the neutral amino acid residue is a polar neutral amino acid residue. In some embodiments, the neutral amino acid residue comprises an amide. In some embodiments, the neutral amino acid residue is selected from Q, N, H, S, T, Y, C, M, W, A, I, L, F, V, P, and G. In some embodiments, the neutral amino acid residue is selected from Q and N. In some embodiments, the neutral amino acid residue is Q.

In some embodiments, the thermophilic DNA polymerase comprises a sequence non-specific double-stranded DNA-binding domain. In some embodiments, the sequence non-specific double-stranded DNA-binding domain comprises an amino acid sequence having at least 75%, 80%, 85%, 90%, 95%, 98%, 99%, or 100% identity to a sequence selected from SEQ ID NOs: 53 to 62. In some embodiments, the sequence non-specific double-stranded DNA-binding domain is C-terminal to the family B polymerase catalytic domain. In some embodiments, the sequence non-specific double-stranded DNA-binding domain is a 7 kD DNA-binding domain. In some embodiments, the sequence non-specific double-stranded DNA-binding domain is an Sso7d, Sac7d, or Sac7e domain.

In some embodiments, the thermophilic DNA polymerase comprises: (a) the consecutive amino acid residues LDFRS (SEQ ID NO: 196), (b) the consecutive amino acid residues FRSLY (SEQ ID NO: 197), or (c) the consecutive amino acid residues SLYPS (SEQ ID NO: 198), wherein the underlined serine residue is within 30 amino acid residues of the N-terminus of the family B polymerase catalytic domain.

In some embodiments, the thermophilic DNA polymerase comprises a 3' to 5' exonuclease domain. In some embodiments, the 3' to 5' exonuclease domain is N-terminal to the family B polymerase catalytic domain. In some embodiments, the 3' to 5' exonuclease domain is a DEDDy archaeal exonuclease domain. In some embodiments, the 3' to 5' exonuclease domain comprises an amino acid sequence having at least 90%, 95%, 98%, 99%, or 100% identity to SEQ ID NO: 63. In some embodiments, the 3' to 5' exonuclease domain comprises an amino acid sequence having at least 90%, 95%, 98%, 99%, or 100% identity to the 3' to 5' exonuclease domain of a sequence selected from SEQ ID NOs: 1, 19, 23, 31, 35, 39, 43, 49, 51, 52, 76 to 79, 92, 96, 102, 104, 106, 108, 110, 112, and 113, 139, 143, 149, 151, 155, 157, 159, and 160.

In some embodiments, the thermophilic DNA polymerase comprises an amino acid sequence having at least 90%, 95%, 98%, 99%, or 100% identity to a sequence selected from SEQ ID NOs: 80 to 113 and 127 to 160, wherein $X^1$ is any amino acid other than P and $X^2$ is the neutral amino acid residue. In some embodiments, $X^1$ is selected from Q, N, H, S, T, Y, C, M, W, A, I, L, F, V, G. In some embodiments, $X^1$ is H. In some embodiments, $X^2$ is selected from Q, N, H, S, T, Y, C, M, W, A, I, L, F, V, P, and G. In some embodiments, $X^2$ is N or G.

In some embodiments, the thermophilic DNA polymerase comprises an amino acid sequence comprising (i) at least one difference at a position corresponding to position 15, 72, 93, 141, 143, 247, 265, 337, 385, 387, 388, 399, 400, 405, 407, 410, 485, 542, 546, 593, or 595 of SEQ ID NO: 1 or (ii) at least one missing residue corresponding to position 92, 93, 94, or 381 of SEQ ID NO: 1. In some embodiments, the at least one mismatch or missing residue comprises at least one of:
(i) a missing residue corresponding to position 92 or 94 of SEQ ID NO: 1;
(ii) a Q or R at the position corresponding to position 93 of SEQ ID NO: 1;
(iii) an A at the position corresponding to position 141 of SEQ ID NO: 1;
(iv) an A at the position corresponding to position 143 of SEQ ID NO: 1;
(v) an I at the position corresponding to position 337 of SEQ ID NO: 1;
(vi) a Q, S, N, L, or H at the position corresponding to position 385 of SEQ ID NO: 1;
(vii) a P or S at the position corresponding to position 387 of SEQ ID NO: 1;
(viii) a P at the position corresponding to position 388 of SEQ ID NO: 1;
(ix) a D at the position corresponding to position 399 of SEQ ID NO: 1;
(x) a G or D at the position corresponding to position 400 of SEQ ID NO: 1;
(xi) an E at the position corresponding to position 405 of SEQ ID NO: 1;
(xii) an I at the position corresponding to position 407 of SEQ ID NO: 1;
(xiii) an L or F at the position corresponding to position 410 of SEQ ID NO: 1;
(xiv) a T at the position corresponding to position 485 of SEQ ID NO: 1;
(xv) a P at the position corresponding to position 542 of SEQ ID NO: 1;
(xvi) an H at the position corresponding to position 546 of SEQ ID NO: 1;
(xvii) a T at the position corresponding to position 593 of SEQ ID NO: 1; or
(xviii) an S at the position corresponding to position 595 of SEQ ID NO: 1.

In some embodiments, the thermophilic DNA polymerase has at least one of the following properties:
(i) capable of amplifying a 2 kb target from 40 ng of human genomic DNA template in the presence of 0.2 µM heparin in a PCR; and/or
(ii) capable of amplifying a 2 kb target from 40 ng of human genomic DNA template in the presence of 400 ng/µl xylan in a PCR;
wherein amplification is successful if product is detectable by agarose gel electrophoresis and ethidium bromide staining within 30 PCR cycles.

In some embodiments, the thermophilic DNA polymerase is capable of amplifying a 2 kb target from 200 ng of human genomic DNA in the presence of at least 100 µM, at least 120 µM, at least 140 µM, at least 160 µM, at least 180 µM, or at least 200 µM dUTP, wherein amplification is successful if product is detectable by agarose gel electrophoresis and ethidium bromide staining within 30 PCR cycles.

In some embodiments, the thermophilic DNA polymerase is bound to a thermolabile inhibitor. In some embodiments, the thermolabile inhibitor comprises an antibody, an Affibody®, an oligonucleotide, such as an aptamer, and/or a chemical modification.

In some embodiments, a method of in vitro nucleic acid synthesis is provided, comprising contacting at least one primer and at least one template with a thermophilic DNA polymerase provided herein in the presence of at least one dNTP. In some embodiments, the thermophilic DNA polymerase is initially bound to a thermolabile inhibitor and the method comprises denaturing the inhibitor. In some embodiments, the method further comprises amplification of the template. In some embodiments, the amplification comprises a PCR.

In some embodiments, a nucleic acid comprising a sequence encoding a thermophilic DNA polymerase described herein is provided. In some embodiments, an expression vector comprising the nucleic acid is provided. In some embodiments, an isolated host cell comprising the nucleic acid or the expression vector is provided. In some embodiments, a method of producing a thermophilic DNA polymerase described herein is provided, comprising culturing at least one host cell comprising a nucleic acid encoding the thermophilic DNA polymerase, wherein the at least one host cell expresses the thermophilic DNA polymerase. In some embodiments, the method further comprises isolating the thermophilic DNA polymerase.

In some embodiments, compositions comprising thermophilic DNA polymerases described herein are provided. In some embodiments, the composition comprises at least one hot start inhibitor. In some embodiments, the composition comprises at least two hot start inhibitors. In some embodiments, each hot start inhibitor is independently selected from an antibody, an Affibody®, an oligonucleotide and/or a chemical modification. In some embodiments, the composition comprises at least two antibodies. In some embodiments, the composition comprises an antibody and an oligonucleotide. In some embodiments, the oligonucleotide is an aptamer. In some embodiments, the composition comprises at least one antibody, and an Affibody® or an aptamer.

In some embodiments, the composition is a storage composition. In some embodiments, the composition comprises at least one protein stabilizer. In some embodiments, the protein stabilizer is selected from BSA, inactive polymerase, and apotransferrin. In some embodiments, the composition comprises a UTPase. In some embodiments, the composition comprises at least one buffering agent. In some embodiments, the buffering agent is selected from acetate buffer, sulfate buffer, phosphate buffer, MOPS, HEPES and Tris-(hydroxymethyl)aminomethane (TRIS). In some embodiments, the composition comprises at least one monovalent cationic salt. In some embodiments, the monovalent cationic salt is selected from KCl and NaCl. In some embodiments, the composition comprises at least one stabilizer. In some embodiments, the stabilizer is selected from glycerol, trehalose, lactose, maltose, galactose, glucose, sucrose, dimethyl sulfoxide (DMSO), polyethylene glycol, and sorbitol. In some embodiments, the composition comprises at least one reducing agent. In some embodiments, the reducing agent is dithiothreitol (DTT). In some embodiments, the composition comprises at least one divalent chelating agent. In some embodiments, the divalent chelating agent is EDTA. In some embodiments, the composition comprises at least one detergent. In some embodiments, the detergent is anionic. In some embodiments, the detergent is cationic. In some embodiments, the detergent is non-ionic. In some embodiments, the detergent is zwitterionic. In some embodiments, the composition comprises a detergent selected from Hecameg (6-O—(N-Heptylcarbamoyl)-methyl-α-D-glucopyranoside), Triton X-200, Brij-58, CHAPS, n-Dodecyl-b-D-maltoside, NP-40, sodium dodecyl sulphate (SDS), TRITON® X-15, TRITON® X-35, TRITON® X-45, TRITON® X-100, TRITON® X-102, TRITON® X-114, TRITON® X-165, TRITON® X-305, TRITON® X-405, TRITON® X-705, Tween® 20 and/or ZWITTERGENT®.

In some embodiments, the composition is an aqueous solution. In some embodiments, the composition is a lyophilized composition.

In some embodiments, the composition is a reaction composition. In some embodiments, the composition comprises at least one buffering agent. In some embodiments, the buffering agent is selected from acetate buffer, sulfate buffer, phosphate buffer, MOPS, HEPES and Tris-(hydroxymethyl) aminomethane (TRIS). In some embodiments, the composition comprises at least one monovalent cationic salt. In some embodiments, the monovalent cationic salt is selected from KCl and NaCl. In some embodiments, the composition comprises at least one divalent cationic salt. In some embodiments, the divalent cationic salt is $MgCl_2$ or $MnCl_2$. In some embodiments, the composition comprises at least one detergent. In some embodiments, the detergent is anionic. In some embodiments, the detergent is cationic. In some embodiments, the detergent is non-ionic. In some embodiments, the detergent is zwitterionic. In some embodiments, the composition comprises a detergent selected from Hecameg (6-O—(N-Heptylcarbamoyl)-methyl-α-D-glucopyranoside), Triton X-200, Brij-58, CHAPS, n-Dodecyl-b-D-maltoside, NP-40, sodium dodecyl sulphate (SDS), TRITON® X-15, TRITON® X-35, TRITON® X-45, TRITON® X-100, TRITON® X-102, TRITON® X-114, TRITON® X-165, TRITON® X-305, TRITON® X-405, TRITON® X-705, Tween® 20 and/or ZWITTERGENT®. In some embodiments, the composition comprises at least one dNTP. In some embodiments, the composition comprises dATP, dGTP, dTTP, and dCTP. In some embodiments, the composition further comprises glycerol, DMSO, and/or ammonium sulphate. In some embodiments, the composition comprises at least one dye. In some embodiments, the composition comprises at least one dye selected from xylene cyanol FF, tartrazine, phenol red, quinoline yellow, zylene cyanol, Brilliant Blue, Patent Blue, indigocarmine, acid red 1, m-cresol purple, cresol red, neutral red, bromocresol green, acid violet 5, bromo phenol blue, and orange G. In some embodiments, the composition comprises at least one agent that increases the density of the composition. In some embodiments, the composition comprises at least one agent selected from PEG 4000 and/or sucrose. In some embodiments, the composition comprises at least one primer. In some embodiments, the composition comprises at least one nucleic acid template.

BRIEF DESCRIPTION OF THE DRAWINGS

FIGS. 11A through 11B show a multiple amino acid sequence alignment of *Thermococcus litoralis* ("Tli"; SEQ ID NO: 31), ("Tsp9N7"; SEQ ID NO: 49), *Thermococcus gorgonarius* ("Tgo"; SEQ ID NO: 39), *Thermococcus kodakarensis* ("Tko"; SEQ ID NO: 43), *Pyrococcus furiosus* ("Pfu"; SEQ ID NO: 2), and Deep Vent ("DP"; SEQ ID NO: 23) polymerases, in which the position corresponding to position 36 of Pfu (SEQ ID NO: 1) is marked with a percent (%), the position corresponding to position 408 of Pfu (SEQ ID NO: 1) is marked with an asterisk (*) and the position corresponding to position 762 of Pfu (SEQ ID NO: 1) is marked with a pound (#). The position corresponding to position 762 of Pfu is indicated as "X" in each amino acid sequence of the sequence alignment. X may be selected from Q, N, H, S, T, Y, C, M, W, A, I, L, F, V, P, and G; in some embodiments, X is selected from Q and N. In some embodiments, X is Q.

FIG. 12 shows a multiple amino acid sequence alignment of the catalytic domains of *Thermococcus litoralis* ("Tli"; SEQ ID NO: 33), ("Tsp9N7"; SEQ ID NO: 47), *Thermococcus gorgonarius* ("Tgo"; SEQ ID NO: 41), *Thermococcus kodakarensis* ("Tko"; SEQ ID NO: 45), *Pyrococcus furiosus* ("Pfu"; SEQ ID NO: 7), and Deep Vent ("DP"; SEQ ID NO: 25) polymerases, in which the position corresponding to position 408 of Pfu in the full-length polymerase (SEQ ID NO: 1; corresponding to position 25 of the Pfu catalytic domain (SEQ ID NO: 6)) is marked with an asterisk (*) and position corresponding to position 762 of Pfu in the full-length polymerase (SEQ ID NO: 1; corresponding to position 379 in the Pfu catalytic domain (SEQ ID NO: 6)) is marked with a pound (#). The position corresponding to position 762 of Pfu (SEQ ID NO: 1; position 379 in the Pfu catalytic domain (SEQ ID NO: 6)) is indicated as "X" in the sequence alignment. X may be selected from Q, N, H, S, T, Y, C, M, W, A, I, L, F, V, P, and G; in some embodiments, X is selected from Q and N. In some embodiments, X is Q.

DETAILED DESCRIPTION

Figure 1:
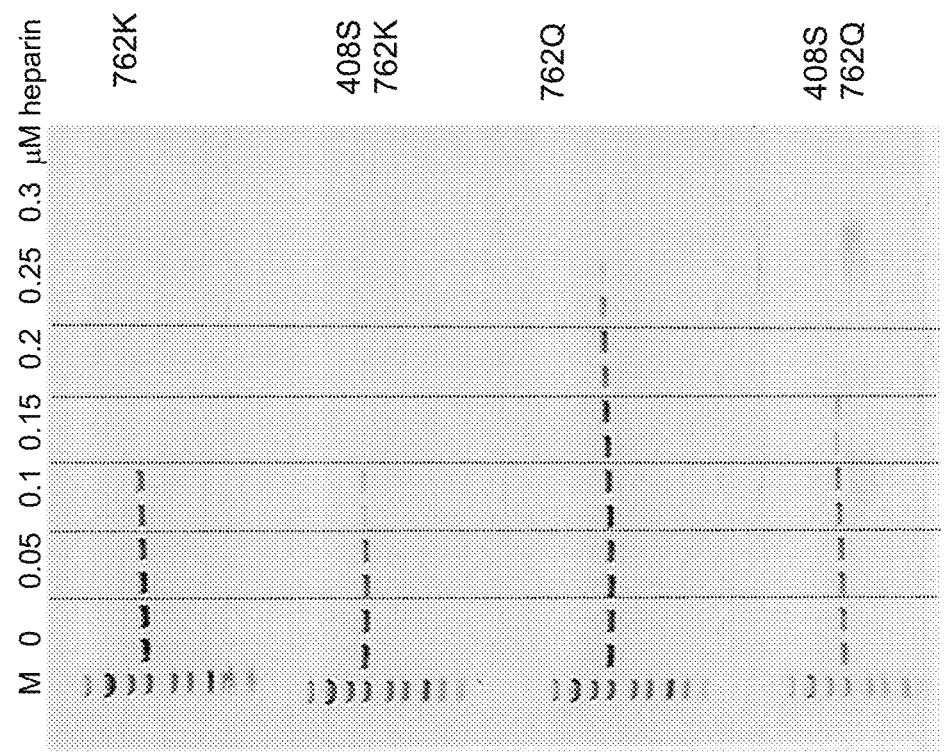
FIG. 1 shows a comparison of PCR amplifications in which heparin was present at a series of concentrations from 0 to 0.3 µM and in which the polymerase comprised a family B thermophilic DNA polymerase catalytic domain with ("762Q") or without ("762K") a neutral amino acid residue at the position that aligns to position 762 of Pfu (SEQ ID NO: 1; aligning to position 379 of the Pfu catalytic domain (SEQ ID NO: 6)) and with ("408S") or without (no 408 designation) a serine at the position that aligns to position 762 of Pfu (SEQ ID NO: 1; aligning to position 25 of the Pfu catalytic domain (SEQ ID NO: 6)).

This description and exemplary embodiments should not be taken as limiting. For the purposes of this specification and appended claims, unless otherwise indicated, all numbers expressing quantities, percentages, or proportions, and other numerical values used in the specification and claims, are to be understood as being modified in all instances by the term "about," to the extent they are not already so modified. Accordingly, unless indicated to the contrary, the numerical parameters set forth in the following specification and attached claims are approximations that may vary depending upon the desired properties sought to be obtained. At the very least, and not as an attempt to limit the application of the doctrine of equivalents to the scope of the claims, each numerical parameter should at least be construed in light of the number of reported significant digits and by applying ordinary rounding techniques.

It is noted that, as used in this specification and the appended claims, the singular forms "a," "an," and "the," and any singular use of any word, include plural referents unless expressly and unequivocally limited to one referent. As used herein, the term "include" and its grammatical variants are intended to be non-limiting, such that recitation of items in a list is not to the exclusion of other like items that can be substituted or added to the listed items.

The term "nucleic acid synthesis" refers to template-directed synthesis of a nucleic acid strand using a polymerase enzyme. Nucleic acid synthesis includes all such template-directed nucleic acid synthesis by a polymerase, including, but not limited to, amplification, PCR, end point PCR (epPCR), real time or quantitative PCR (qPCR), one-step RT-PCR, sequencing, etc.

As used herein the terms "amplify", "amplifying", "amplification" and other related terms include producing multiple copies of an original biomolecule, such as a nucleic acid. In some embodiments, nucleic acid amplification produces multiple copies of an original nucleic acid and/or its complement (e.g., target nucleic acid, also referred to as a target polynucleotide), where the copies comprise at least a portion of the template sequence and/or its complement. Such copies may be single-stranded or double-stranded.

A "template" or "template nucleic acid" or "template polynucleotide" refers to a polynucleotide that comprises the polynucleotide sequence to be amplified. In some embodiments, the polynucleotide sequence to be amplified is flanked by primer hybridization sites, such as a hybridization site for a 5' primer (or the complement thereof) and a hybridization site for a 3' primer (or the complement thereof). A template may comprise RNA and/or DNA, and may be from a natural source, or be synthetic. Nonlimiting exemplary templates include genomic DNA, viral DNA, mitochondrial DNA, viral RNA, mRNA, tRNA, microRNA, plasmids, vectors, cosmids, artificial chromosomes, etc. Any polynucleotide that may be copied or amplified by a polymerase enzyme is considered a template.

"Domain" refers to a unit of a protein or protein complex, comprising a polypeptide subsequence, a complete polypeptide sequence, or a plurality of polypeptide sequences where that unit has a defined function. The function is understood to be broadly defined and can be ligand binding, catalytic activity, and/or can have a stabilizing effect on the structure of the protein.

Residues "correspond" to each other where they occur at equivalent positions in aligned amino acid sequences, such as family B thermophilic polymerase sequences and/or a domain thereof, such as a uracil-binding pocket, catalytic domain, or exonuclease domain. Corresponding positions can be identified as positions that align with one another. Related or variant polypeptides are aligned by any method in the art. Such methods typically maximize matches, and include methods such as using manual alignments and by using any of the numerous alignment programs available (for example, BLASTP) and others known in the art. By aligning the sequences of polypeptides, one of skill in the art can identify corresponding residues, using conserved and identical amino acid residues as guides. In some embodiments, an amino acid of a polypeptide is considered to correspond to an amino acid in a disclosed sequence when the amino acid of the polypeptide is aligned with the amino acid in the disclosed sequence upon alignment of the polypeptide with the disclosed sequence to maximize identity and homology (e.g., where conserved amino acids are aligned) using a standard alignment algorithm, such as the BLASTP algorithm with default scoring parameters (such as, for example, BLOSUM62 Matrix, Gap existence penalty 11, Gap extension penalty 1, and with default general parameters). As a non-limiting example, with reference to the multiple sequence alignment shown in FIGS. 11A-C, amino acid residue 408 in SEQ ID NO: 9 corresponds to positions 410, 407, 407, 407, and 408 in SEQ ID NOs: 52, 57, 55, 56, and 51, respectively (marked with an asterisk in FIG. 11A). As another non-limiting example, amino acid residue 762 in SEQ ID NO: 9 corresponds to positions 764, 761, 761, 761, and 762 in SEQ ID NOs: 52, 57, 55, 56, and 51, respectively (marked with a pound in FIG. 11B). As another non-limiting example, amino acid residue 36 in SEQ ID NO: 9 corresponds to position 36 in SEQ ID NOs: 52, 57, 55, 56, and 51 (marked with a percent in FIG. 11B). In some embodiments, corresponding positions can also be identified using overlaid 3-D structures, where available, as positions at which greater than 50% of the volume occupied by a space-filling model of an amino acid in a first polypeptide is occupied by the space-filling model of the corresponding amino acid in a second polypeptide.

"Identity" is measured by a score determined by comparing the amino acid sequences of the two polypeptides using the Bestfit program. Bestfit uses the local homology algorithm of Smith and Waterman, Advances in Applied Mathematics 2:482-489 (1981) to find the best segment of similarity between two sequences. When using Bestfit to determine whether a test amino acid sequence is, for instance, 95% identical to a reference sequence according to the present disclosure, the parameters are set so that the percentage of identity is calculated over the full length of the test amino acid sequence, such that 95% of the amino acids in the test amino acid sequence align with identical amino acids on the reference sequence.

"Sequence-non-specific DNA binding domain" or "DNA binding domain" refers to a protein domain that binds to DNA without significant sequence preference. In some embodiments, a DNA binding domain binds to double-stranded DNA. Non-limiting exemplary DNA binding domains include Sso7d from *Sulfolobus solfataricus*, Sac7d, Sac7a, Sac7b, and Sac7e from *S. acidocaldarius*, and Ssh7a and Ssh7b from *Sulfolobus shibatae*, Pae3192, Pae0384, and Ape3192, HMf family archaeal histone domains, and archaeal PCNA homolog.

With reference to two polypeptides or two polypeptide domains, the term "fused" means that the two polypeptides or polypeptide domains are contained in a single contiguous polypeptide sequence.

"Heterologous", when used with reference to portions of a protein, indicates that the protein comprises two or more domains that are not found in the same relationship to each other in nature. In some embodiments, such a protein, e.g., a fusion protein, contains two or more domains from unrelated proteins arranged to make a new functional protein.

"Error-correcting activity" of a polymerase or polymerase domain refers to the 3' to 5' exonuclease proofreading activity of a polymerase whereby nucleotides that do not form Watson-Crick base pairs with the template are removed from the 3' end of an oligonucleotide, i.e., a strand being synthesized from a template, in a sequential manner. Examples of polymerases that have error-correcting activity include polymerases from *Pyrococcus furiosus, Thermococcus litoralis*, and *Thermotoga maritima* with wild-type exonuclease domains, and certain others discussed herein.

"Sensitivity" as used herein, refers to the ability of a polymerase to amplify a target nucleic acid that is present at low copy number. In some embodiments, low copy number refers to a target nucleic acid that is present at fewer than 10,000 or fewer than 1,000 or fewer than 100 or fewer than 10 copies in the composition comprising the target nucleic acid and the polymerase.

"Specificity" as used herein, refers to the ability of a polymerase to amplify a target nucleic acid while producing fewer non-specific amplification byproducts, such as those resulting from primer-dimers.

As used herein the terms "hybridize", "hybridizing", "hybridization" and other related terms include hydrogen bonding between two different nucleic acids, or between two different regions of a nucleic acid, to form a duplex nucleic acid. Hybridization can comprise Watson-Crick or Hoogstein binding to form a duplex nucleic acid. The two different nucleic acids, or the two different regions of a nucleic acid, may be complementary, or partially complementary. The complementary base pairing can be the standard A-T or C-G base pairing, or can be other forms of base-pairing interactions. Duplex nucleic acids can include mismatched base-paired nucleotides. Complementary nucleic acid strands need not hybridize with each other across their entire length.

In some embodiments, conditions that are suitable for nucleic acid hybridization and/or nucleic acid synthesis include parameters such as salts, buffers, pH, temperature, % GC content of the polynucleotide and primers, and/or time. For example, conditions suitable for hybridizing nucleic acids (e.g., polynucleotides and primers) can include hybridization solutions having sodium salts, such as NaCl, sodium citrate and/or sodium phosphate. In some embodiments, a hybridization solution can be a stringent hybridization solution which can include any combination of formamide (e.g., about 50%), 5×SSC (e.g., about 0.75 M NaCl and about 0.075 M sodium citrate), sodium phosphate (e.g., about 50 mM at about pH 6.8), sodium pyrophosphate (e.g., about 0.1%), 5×Denhardt's solution, SDS (e.g., about 0.1%), and/or dextran sulfate (e.g., about 10%). In some embodiments, hybridization and/or nucleic acid synthesis can be conducted at a temperature range of about 45-55° C., or about 55-65° C., or about 65-75° C.

In some embodiments, hybridization or nucleic acid synthesis conditions can be conducted at a pH range of about 5-10, or about pH 6-9, or about pH 6.5-8, or about pH 6.5-7.

Thermal melting temperature ($T_m$) for nucleic acids can be a temperature at which half of the nucleic acid strands are double-stranded and half are single-stranded under a defined condition. In some embodiments, a defined condition can include ionic strength and pH in an aqueous reaction condition. A defined condition can be modulated by altering the concentration of salts (e.g., sodium), temperature, pH, buffers, and/or formamide. Typically, the calculated thermal melting temperature can be at about 5-30° C. below the $T_m$, or about 5-25° C. below the $T_m$, or about 5-20° C. below the $T_m$, or about 5-15° C. below the $T_m$, or about 5-10° C. below the $T_m$. Methods for calculating a $T_m$ are well known and can be found in Sambrook (1989 in "Molecular Cloning: A Laboratory Manual", 2$^{nd}$ edition, volumes 1-3; Wetmur 1966, J. Mol. Biol., 31:349-370; Wetmur 1991 Critical Reviews in Biochemistry and Molecular Biology, 26:227-259). Other sources for calculating a $T_m$ for hybridizing or denaturing nucleic acids include OligoAnalyze (from Integrated DNA Technologies) and Primer3 (distributed by the Whitehead Institute for Biomedical Research).

Provided herein are thermophilic DNA polymerases comprising a family B polymerase N-terminal domain comprising a uracil-binding pocket in which a proline is replaced with another amino acid, and a family B polymerase catalytic domain in which a neutral amino acid residue is present at a certain position. Many types of Family B polymerases are described in Rothwell and Watsman, *Advances in Protein Chemistry* 71:401-440 (2005). Examples of thermophilic Family B polymerases include those of the *Pyrococcus* and *Thermococcus* genera, such as the Deep Vent polymerase and Family B polymerases of *P. furiosus, P. calidifontis, P. aerophilum, T. kodakarensis, T. gorgonarius*, and *Thermococcus* sp. 9° N-7. Exemplary wild-type amino acid sequences for such thermophilic family B polymerases can be obtained from public databases such as NCBI GenBank or UniProt. Wild-type sequences include naturally-occurring variants of the amino acid sequences for such thermophilic family B polymerases can be obtained from public databases such as NCBI GenBank or UniProt. Note that in some cases, the sequences are annotated as containing inteins; the inteins are not present in the mature enzyme.

In some embodiments, the family B polymerase N-terminal domain comprising a uracil-binding pocket has an amino acid sequence in which the position corresponding to position 36 of SEQ ID NO: 1 is any amino acid other than P. In some embodiments, the family B polymerase N-terminal domain comprising a uracil-binding pocket has an amino acid sequence wherein the amino acid residue at the position of the amino acid sequence that aligns to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to a sequence selected from SEQ ID NOs: 115 to 121 and 162 to 168, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 115, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 116, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 117, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 118, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 119, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 120, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 121, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 162, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 163, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 164, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 165, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 166, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 167, wherein the position corresponding to position 36 of SEQ ID NO: 1 is any amino acid other than P. In some embodiments, the family B polymerase N-terminal domain comprising a uracil-binding pocket has at least 80%, 85%, 90%, 95%, 98%, 99%, or 100% identity to SEQ ID NO: 168, wherein the position corresponding to position 36 of SEQ ID NO: 1 is any amino acid other than P.

In some embodiments, the family B polymerase catalytic domain has an amino acid sequence in which the position corresponding to position 379 of SEQ ID NO: 6 is a neutral amino acid residue. In some embodiments, the family B polymerase catalytic domain has an amino acid sequence wherein the amino acid residue at the position of the amino acid sequence that aligns to position 379 of SEQ ID NO: 6 is a neutral amino acid residue. In some embodiments, the family B polymerase catalytic domain has at least 80%, 85%, 90%, 95%, 98%, 99%, or 100% identity to a sequence selected from SEQ ID NOs: 6 to 10, 15 to 18, 25, 26, 33, 34, 37, 38, 41, 42, and 45 to 48, wherein the position corresponding to position 379 of SEQ ID NO: 6 is a neutral amino acid residue. In some embodiments, the family B polymerase catalytic domain has at least 80%, 85%, 90%, 95%, 98%, 99%, or 100% identity to SEQ ID NO: 7, wherein the position corresponding to position 379 of SEQ ID NO: 6 is a neutral amino acid residue. In some embodiments, the family B polymerase catalytic domain has at least 80%, 85%, 90%, 95%, 98%, 99%, or 100% identity to the catalytic domain of SEQ ID NO: 15, wherein the position corresponding to position 379 of SEQ ID NO: 6 is a neutral amino acid residue. In some embodiments, the family B polymerase catalytic domain has at least 80%, 85%, 90%, 95%, 98%, 99%, or 100% identity to the catalytic domain of SEQ ID NO: 25, wherein the position corresponding to position 379 of SEQ ID NO: 6 is a neutral amino acid residue. In some embodiments, the family B polymerase catalytic domain has at least 80%, 85%, 90%, 95%, 98%, 99%, or 100% identity to the catalytic domain of SEQ ID NO: 33, wherein the position corresponding to position 379 of SEQ ID NO: 6 is a neutral amino acid residue. In some embodiments, the family B polymerase catalytic domain has at least 80%, 85%, 90%, 95%, 98%, 99%, or 100% identity to the catalytic domain of SEQ ID NO: 37, wherein the position corresponding to position 379 of SEQ ID NO: 6 is a neutral amino acid residue. In some embodiments, the family B polymerase catalytic domain has at least 80%, 85%, 90%, 95%, 98%, 99%, or 100% identity to the catalytic domain of SEQ ID NO: 47, wherein the position corresponding to position 379 of SEQ ID NO: 6 is a neutral amino acid residue. In some embodiments, the family B polymerase catalytic domain has at least 80%, 85%, 90%, 95%, 98%, 99%, or 100% identity to the catalytic domain of SEQ ID NO: 41, wherein the position corresponding to position 379 of SEQ ID NO: 6 is a neutral amino acid residue. In some embodiments, the family B polymerase catalytic domain has at least 80%, 85%, 90%, 95%, 98%, 99%, or 100% identity to the catalytic domain of SEQ ID NO: 45, wherein the position corresponding to position 379 of SEQ ID NO: 6 is a neutral amino acid residue.

Examples of family B polymerase catalytic domain sequences are shown, e.g., in FIG. 12. In some embodiments, the C-terminus is the residue at the position of the conserved leucine shown as the last residue in the multiple sequence alignment in FIG. 12. In some embodiments, the C-terminus of the family B polymerase catalytic domain is the position corresponding to position 383 of SEQ ID NO: 6. In some embodiments, the C-terminus of the family B polymerase catalytic domain is the position corresponding to the leucine which is the last residue of SEQ ID NO: 6. In some embodiments, the C-terminus of the family B polymerase catalytic domain is the position that aligns to the leucine which is the last residue of SEQ ID NO: 6. In some embodiments, the C-terminus of the family B polymerase catalytic domain is the position corresponding to a leucine selected from the leucines shown as the final residues in FIG. 12. In some embodiments, the C-terminus of the family B polymerase catalytic domain is the position that aligns to a leucine selected from the leucines shown as the final residues in FIG. 12. The C-terminal residue in any of the foregoing embodiments can be a leucine.

In some embodiment, the thermophilic DNA polymerase comprises an N-terminal domain comprising a uracil-binding pocket that comprises: (a) the consecutive amino acid residues RX¹YFY (SEQ ID NO: 199), (b) the consecutive amino acid residues QX¹YIY (SEQ ID NO: 200), (c) the consecutive amino acid residues EX¹YIY (SEQ ID NO: 201), (d) the consecutive amino acid residues EX¹YFY (SEQ ID NO: 202), or (e) the consecutive amino acid residues RX¹YFY (SEQ ID NO: 203); wherein X¹ is any amino acid other than P; and wherein X¹ is within 50, 45, 44, 43, 42, 41, 40, 39, 38, 37, 36, 35, 34, 33, 32, 31, or 30 residues of the N-terminus of the family B polymerase N-terminal domain comprising a uracil-binding pocket. In some embodiments, the N-terminus of the family B polymerase N-terminal domain comprising a uracil-binding pocket is the N-terminus of the thermophilic DNA polymerase. In some embodiments, X¹ is within 42, 41, 40, 39, 38, 37, or 36 residues of the N-terminus of the family B polymerase N-terminal domain comprising a uracil-binding pocket. In some embodiments, X¹ is within 42 residues of the N-terminus of the family B polymerase N-terminal domain comprising a uracil-binding pocket. In some embodiments, X¹ is within 40 residues of the N-terminus of the family B polymerase N-terminal domain comprising a uracil-binding pocket. In some embodiments, X¹ is within 36 residues of the N-terminus of the family B polymerase N-terminal domain comprising a uracil-binding pocket.

In some embodiments, the thermophilic DNA polymerase comprises: (a) the consecutive amino acid residues WQKTX² (SEQ ID NO: 204), (b) the consecutive amino acid residues YQKTX² (SEQ ID NO: 205), (c) the consecutive amino acid residues X²QTGL (SEQ ID NO: 206), (d) the consecutive amino acid residues X²QVGL (SEQ ID NO: 207), (e) the consecutive amino acid residues KTX²QT (SEQ ID NO: 208), or (f) the consecutive amino acid residues KTX²QV (SEQ ID NO: 209); wherein X² is a neutral amino acid residue; and wherein X² is within 20, 15, 10, 5, or 4 residues of the C-terminus of the family B polymerase catalytic domain. In some embodiments, The C-terminus of the family B polymerase catalytic domain can be identified as the amino acid that aligns to or corresponds to the last amino acid of SEQ ID NO: 6. In some embodiments, the thermophilic DNA polymerase comprises a consecutive amino acid sequence of WQKTX² (SEQ ID NO: 204), X²QTGL (SEQ ID NO: 206), KTX²QT (SEQ ID NO: 208), YQKTX² (SEQ ID NO: 205), X²QVGL (SEQ ID NO: 207), KTX²QV (SEQ ID NO: 209), YQSSX² (SEQ ID NO: 210), X²QTGL (SEQ ID NO: 206), SSX²QT (SEQ ID NO: 211), wherein X² is a neutral amino acid residue; and wherein X² is within 20, 15, 10, 5, or 4 residues of the C-terminus of the family B polymerase catalytic domain. In some embodiments, the thermophilic DNA polymerase comprises a consecutive amino acid sequence of WQKTX² (SEQ ID NO: 204), X²QTGL (SEQ ID NO: 206), KTX²QT (SEQ ID NO: 208), YQKTX² (SEQ ID NO: 205), X²QVGL (SEQ ID NO: 207), KTX²QV (SEQ ID NO: 209), YQSSX² (SEQ ID NO: 210), X²QTGL (SEQ ID NO: 206), SSX²QT (SEQ ID NO: 211), TGRVX² (SEQ ID NO: 212), X²KSLL (SEQ ID NO: 213), RVX²KS (SEQ ID NO: 214), TGRSX² (SEQ ID NO: 215), X²RTLL (SEQ ID NO: 216), or RSX²RT (SEQ ID NO: 217);

wherein X² is a neutral amino acid residue; and wherein X² is within 20, 15, 10, 5, or 4 residues of the C-terminus of the family B polymerase catalytic domain. X² can be within 15 residues of the C-terminus of the family B polymerase catalytic domain in any of the foregoing embodiments. X² can be within 10 residues of the C-terminus of the family B polymerase catalytic domain in any of the foregoing embodiments. X² can be within 5 residues of the C-terminus of the family B polymerase catalytic domain in any of the foregoing embodiments. X² can be within 4 residues of the C-terminus of the family B polymerase catalytic domain in any of the foregoing embodiments. For the avoidance of doubt, in a sequence segment consisting of n residues, residues 1 to n are within n−1 residues of position n; e.g., if n is 5, positions 1, 2, 3, 4, and 5 and are within 4 residues of position 5.

This paragraph concerns the neutral amino acid residue referred to in any of the embodiments mentioned in the preceding paragraphs. Neutral amino acid residues do not have side chains containing groups that are more than 50% charged at pH 7.4 in aqueous solution at 37° C., such as carboxyls, amines, and guanidino groups. Neutral amino acid residues include canonical and noncanonical residues unless indicated to the contrary. In some embodiments, the neutral amino acid is a noncanonical residue. A noncanonical residue is a residue other than the twenty amino acid residues abbreviated as one of the twenty following letters: A, C, D, E, F, G, H, I, K, L, M, N, P, Q, R, S, T, V, W, Y (e.g., norleucine and selenomethionine are noncanonical; see, e.g., U.S. Pat. No. 7,541,170 for additional examples of noncanonical residues, which are referred to therein as "nonclassical amino acids or chemical amino acid analogs"). In some embodiments, the neutral amino acid is less than 10%, 1%, 0.1%, or 0.01% charged at pH 7.4 in aqueous solution at 37° C. In some embodiments, the neutral amino acid residue is a polar neutral amino acid residue. A residue is polar if its side chain contains at least one hydrogen bond donor or acceptor. In some embodiments, the neutral amino acid comprises a side chain comprising an alcohol, amide, carbonyl, ester, or ether. In some embodiments, the neutral amino acid comprises a side chain comprising an alcohol. In some embodiments, the neutral amino acid comprises a side chain comprising an amide. In some embodiments, the neutral amino acid residue is Q, N, H, S, T, Y, C, M, W, A, I, L, F, V, P, or G. In some embodiments, the neutral amino acid residue is Q, N, H, S, T, Y, C, M, W, A, I, L, F, V, or G. In some embodiments, the neutral amino acid residue is Q, N, S, T, C, M, A, I, L, V, or G. In some embodiments, the neutral amino acid residue is Q, N, S, T, C, M, A, or G. In some embodiments, the neutral amino acid residue is Q, N, H, S, T, Y, C, M, or W. In some embodiments, the neutral amino acid residue is Q, N, H, S, T, Y, or W. In some embodiments, the neutral amino acid residue is Q, N, H, S, T, C, or M. In some embodiments, the neutral amino acid residue is Q, N, S, T, C, or M. In some embodiments, the neutral amino acid residue is Q, N, S, or T. In some embodiments, the neutral amino acid residue is Q or N. In some embodiments, the neutral amino acid residue is S. In some embodiments, the neutral amino acid residue is T. In some embodiments, the neutral amino acid residue is Q. In some embodiments, the neutral amino acid residue is N.

In some embodiments, the family B polymerase catalytic domain is a subfamily B3 polymerase domain. In some embodiments, the family B polymerase catalytic domain is a family B polymerase domain of a *Pyrococcus* in which a neutral amino acid residue is present at a position discussed above. In some embodiments, the family B polymerase catalytic domain is a family B polymerase domain of a *Thermococcus* in which a neutral amino acid residue is present at a position discussed above. In some embodiments, the family B polymerase catalytic domain is a family B polymerase domain of a *Pyrobaculum* in which a neutral amino acid residue is present at a position discussed above. In some embodiments, the family B polymerase catalytic domain is a family B polymerase domain of *Pyrococcus furiosus* in which a neutral amino acid residue is present at a position discussed above. In some embodiments, the family B polymerase catalytic domain is a family B polymerase domain of *Pyrococcus* species GB-D in which a neutral amino acid residue is present at a position discussed above. In some embodiments, the family B polymerase catalytic domain is a family B polymerase domain of *Thermococcus kodakarensis* in which a neutral amino acid residue is present at a position discussed above. In some embodiments, the family B polymerase catalytic domain is a family B polymerase domain of *Thermococcus litoralis* in which a neutral amino acid residue is present at a position discussed above. In some embodiments, the family B polymerase catalytic domain is a family B polymerase domain of *Thermococcus gorgonarius* in which a neutral amino acid residue is present at a position discussed above. In some embodiments, the family B polymerase catalytic domain is a family B polymerase domain of *Thermococcus* sp. 9° N-7 in which a neutral amino acid residue is present at a position discussed above. In some embodiments, the family B polymerase catalytic domain is a family B polymerase domain of *Pyrobaculum calidifontis* in which a neutral amino acid residue is present at a position discussed above. In some embodiments, the family B polymerase catalytic domain is a family B polymerase domain of *Pyrobaculum aerophilum* in which a neutral amino acid residue is present at a position discussed above.

In some embodiments, the family B polymerase N-terminal domain comprising a uracil-binding pocket is a subfamily B3 N-terminal domain. In some embodiments, the family B polymerase N-terminal domain comprising a uracil-binding pocket is a family B N-terminal domain of a *Pyrococcus* in which the position corresponding to position 36 of SEQ ID NO: 1 is any amino acid other than P. In some embodiments, the family B polymerase N-terminal domain comprising a uracil-binding pocket is a family B N-terminal domain of a *Thermococcus* in which the position corresponding to position 36 of SEQ ID NO: 1 is any amino acid other than P. In some embodiments, the family B polymerase N-terminal domain comprising a uracil-binding pocket is a family B N-terminal domain of a *Pyrobaculum* in which the position corresponding to position 36 of SEQ ID NO: 1 is any amino acid other than P. In some embodiments, the family B polymerase N-terminal domain comprising a uracil-binding pocket is a family B N-terminal domain of *Pyrococcus furiosus* in which the position corresponding to position 36 of SEQ ID NO: 1 is any amino acid other than P. In some embodiments, the family B polymerase N-terminal domain comprising a uracil-binding pocket is a family B N-terminal domain of *Pyrococcus* species GB-D in which the position corresponding to position 36 of SEQ ID NO: 1 is any amino acid other than P. In some embodiments, the family B polymerase N-terminal domain comprising a uracil-binding pocket is a family B N-terminal domain of *Thermococcus kodakarensis* in which the position corresponding to position 36 of SEQ ID NO: 1 is any amino acid other than P. In some embodiments, the family B polymerase N-terminal domain comprising a uracil-binding pocket is a family B N-terminal domain of *Thermococcus litoralis* in which the position corresponding to position 36 of SEQ ID NO: 1 is any amino acid other than P. In some embodiments, the family B polymerase N-terminal domain comprising a uracil-binding pocket is a family B N-terminal domain of *Thermococcus gorgonarius* in which the position corresponding to position 36 of SEQ ID NO: 1 is any amino acid other than P. In some embodiments, the family B polymerase N-terminal domain comprising a uracil-binding pocket is a family B N-terminal domain of *Thermococcus* sp. 9° N-7 in which the position corresponding to position 36 of SEQ ID NO: 1 is any amino acid other than P. In some embodiments, the family B polymerase N-terminal domain comprising a uracil-binding pocket is a family B N-terminal domain of *Pyrobaculum calidifontis* in which the position corresponding to position 36 of SEQ ID NO: 1 is any amino acid other than P. In some embodiments, the family B polymerase N-terminal domain comprising a uracil-binding pocket is a family B N-terminal domain of *Pyrobaculum aerophilum* in which the position corresponding to position 36 of SEQ ID NO: 1 is any amino acid other than P.

In some embodiments, all domains of the thermophilic DNA polymerase are contained in a single polypeptide. In some embodiments, the thermophilic DNA polymerase comprises a plurality of polypeptide chains, which may be noncovalently associated or covalently associated. In some embodiments, the plurality of polypeptide chains can include a first polypeptide comprising an N-terminal domain comprising a uracil-binding procket and a polymerase catalytic domain and a second polypeptide comprising an additional domain, such as a sequence non-specific double-stranded DNA-binding domain. A covalent association can include, e.g., one or more disulfide bonds or chemical conjugation using a linking compound, e.g., a chemical crosslinking agent, including, for example, succinimidyl-(N-maleimidomethyl)-cyclohexane-1-carboxylate (SMCC). Disulfide bonds and chemical conjugation are discussed further below.

In some embodiments, the thermophilic DNA polymerase comprises a sequence non-specific DNA-binding domain, e.g., a thermostable DNA binding domain. The DNA binding domain can be, for example, present as part of a fusion protein with the polymerase catalytic domain. In some embodiments, the DNA binding domain is fused C-terminal to the polymerase catalytic domain. In some embodiments, the DNA binding domain is noncovalently associated with the polypeptide comprising the polymerase catalytic domain, e.g., in the manner of the association between sliding clamps and certain family B polymerases. In some embodiments, the polypeptide comprising the polymerase catalytic domain further comprises a sequence that noncovalently associates with an DNA binding domain, such as the PCNA-interacting sequence of a dimeric archaeal polymerase such as Pfu Pol II. As discussed, e.g., in U.S. Pat. No. 7,541,170, an DNA binding domain can provide improved processivity relative to version of the enzyme lacking the DNA binding domain. Processivity reflects the extent to which a polymerase continues to synthesize DNA (adding nucleotides in processive catalytic events) along the same template without falling off. In some embodiments, high processivity correlates to high sensitivity in amplification reactions.

In some embodiments, the DNA binding domain is covalently conjugated to the polypeptide comprising the polymerase catalytic domain. Techniques for covalent conjugation of heterologous domains are described, e.g., in BIOCONJUGAIE TECHNIQUES, Hermanson, Ed., Academic Press (1996). Such techniques include, for example, derivitization for the purpose of linking the moieties to each other, either directly or through a linking compound, by methods that are well known in the art of protein chemistry. For example, in one chemical conjugation embodiment, the catalytic domain and the nucleic acid binding domain are linked using a heterobifunctional coupling reagent which ultimately contributes to formation of an intermolecular disulfide bond between the two moieties. Other types of coupling reagents that are useful in this capacity for the present invention are described, for example, in U.S. Pat. No. 4,545,985. Alternatively, an intermolecular disulfide may conveniently be formed between cysteines in each moiety, which occur naturally or are inserted by genetic engineering. The means of linking moieties may also use thioether linkages between heterobifunctional crosslinking reagents or specific low pH cleavable crosslinkers or specific protease cleavable linkers or other cleavable or noncleavable chemical linkages.

In some embodiments, the sequence non-specific double-stranded DNA-binding domain comprises an amino acid sequence having at least 75%, 80%, 85%, 90%, 95%, 98%, 99%, or 100% identity to an amino acid sequence selected from SEQ ID NOs: 53 to 62. In some embodiments, the DNA binding domain is an archaeal DNA binding domain. In some embodiments, the DNA binding domain is a 7 kD DNA-binding domain, which occurs in certain archaeal small basic DNA binding proteins (see, e.g., Choli et al., Biochimica et Biophysica Acta 950:193-203, 1988; Baumann et al., Structural Biol. 1:808-819, 1994; and Gao et al, Nature Struc. Biol. 5:782-786, 1998). Additional archaeal DNA binding domains are discussed in Hardy and Martin, Extremophiles 12:235-46 (2008).

In some embodiments, the DNA binding domain is an Sso7d domain. In some embodiments, the DNA binding domain is a Sac7d domain. In some embodiments, the DNA binding domain is a Sac7e domain. In some embodiments, the sequence non-specific double-stranded DNA-binding domain comprises an amino acid sequence having at least 75%, 80%, 85%, 90%, 95%, 98%, 99%, or 100% identity to SEQ ID NO: 53. In some embodiments, the sequence non-specific double-stranded DNA-binding domain comprises an amino acid sequence having at least 75%, 80%, 85%, 90%, 95%, 98%, 99%, or 100% identity to SEQ ID NO: 54. In some embodiments, the sequence non-specific double-stranded DNA-binding domain comprises an amino acid sequence having at least 75%, 80%, 85%, 90%, 95%, 98%, 99%, or 100% identity to SEQ ID NO: 62.

In some embodiments, the DNA binding domain is a Pae3192 domain. In some embodiments, the DNA binding domain is a Pae0384 domain. In some embodiments, the DNA binding domain is a Ape3192 domain. In some embodiments, the sequence non-specific double-stranded DNA-binding domain comprises an amino acid sequence having at least 75%, 80%, 85%, 90%, 95%, 98%, 99%, or 100% identity to SEQ ID NO: 55. In some embodiments, the sequence non-specific double-stranded DNA-binding domain comprises an amino acid sequence having at least 75%, 80%, 85%, 90%, 95%, 98%, 99%, or 100% identity to SEQ ID NO: 56. In some embodiments, the sequence non-specific double-stranded DNA-binding domain comprises an amino acid sequence having at least 75%, 80%, 85%, 90%, 95%, 98%, 99%, or 100% identity to SEQ ID NO: 57.

In some embodiments, the DNA binding domain is an archaeal histone domain. In some embodiments, the archaeal histone domain is an HMf family archaeal histone domain (see, e.g., Starich et al., J Molec. Biol. 255:187-203, 1996; Sandman et al., Gene 150:207-208, 1994). In some embodiments, the archaeal histone domain is an HMf family archaeal histone domain from *Methanothermus*. In some embodiments, the archaeal histone domain is an HMf family archaeal histone domain from *Pyrococcus*. In some embodiments, the archaeal histone domain is an HMf family archaeal histone domain from *Methanothermus fervidus*. In some embodiments, the archaeal histone domain is an HMf family archaeal histone domain from *Pyrococcus* strain GB-3a. In some embodiments, the archaeal histone domain is a *Methanothermus* HMfA archaeal histone domain. In some embodiments, the archaeal histone domain is a *Methanothermus* HMfB archaeal histone domain. In some embodiments, the archaeal histone domain is a *Pyrococcus* HpyA1 archaeal histone domain. In some embodiments, the archaeal histone domain is a *Pyrococcus* HpyA2 archaeal histone domain. In some embodiments, the sequence non-specific double-stranded DNA-binding domain comprises an amino acid sequence having at least 75%, 80%, 85%, 90%, 95%, 98%, 99%, or 100% identity to SEQ ID NO: 58. In some embodiments, the sequence non-specific double-stranded DNA-binding domain comprises an amino acid sequence having at least 75%, 80%, 85%, 90%, 95%, 98%, 99%, or 100% identity to SEQ ID NO: 59. In some embodiments, the sequence non-specific double-stranded DNA-binding domain comprises an amino acid sequence having at least 75%, 80%, 85%, 90%, 95%, 98%, 99%, or 100% identity to SEQ ID NO: 60. In some embodiments, the sequence non-specific double-stranded DNA-binding domain comprises an amino acid sequence having at least 75%, 80%, 85%, 90%, 95%, 98%, 99%, or 100% identity to SEQ ID NO: 61.

In some embodiments, the DNA binding domain is a sliding clamp, such as an archaeal PCNA homolog. Sliding clamps can exist as trimers in solution, and can form a ring-like structure with a central passage capable of accommodating double-stranded DNA. The sliding clamp forms specific interactions with the amino acids located at the C terminus of particular DNA polymerases, and tethers those polymerases to the DNA template during replication. The sliding clamp in eukaryotes is referred to as the proliferating cell nuclear antigen (PCNA), while similar proteins in other domains are often referred to as PCNA homologs. These homologs have marked structural similarity but limited sequence similarity. PCNA homologs have been identified from thermophilic Archaea (e.g., *Sulfolobus solfataricus*, *Pyrococcus furiosus*, etc.). Some family B polymerases in Archaea have a C terminus containing a consensus PCNA-interacting amino acid sequence and are capable of using a PCNA homolog as a processivity factor (see, e.g., Cann et al., J. Bacteriol. 181:6591-6599, 1999 and De Felice et al., J Mol. Biol. 291:47-57, 1999). These PCNA homologs are useful sequence-non-specific double-stranded DNA binding domains. For example, a consensus PCNA-interacting sequence can be joined to a polymerase that does not naturally interact with a PCNA homolog, thereby allowing a PCNA homolog to serve as a processivity factor for the polymerase. By way of illustration, the PCNA-interacting sequence from *Pyrococcus furiosus* Pol II (a heterodimeric DNA polymerase containing two family B-like polypeptides) can be covalently joined to a sequence based on *Pyrococcus furiosus* Pol I (a monomeric family B polymerase that does not normally interact with a PCNA homolog). The resulting fusion protein can then be allowed to associate non-covalently with the *Pyrococcus furiosus* PCNA homolog to generate a heterologous protein with increased processivity.

Nucleic acids encoding the domains of a fusion protein invention can be obtained using recombinant genetics techniques. Basic texts disclosing the general methods for doing so include Sambrook et al., MOLECULAR CLONING, A LABORATORY MANUAL (2nd ed. 1989); Kriegler, GENE TRANSFER AND EXPRESSION: A LABORATORY MANUAL (1990); and CURRENT PROTOCOLS IN MOLECULAR BIOLOGY (Ausubel et al., eds., 1994)).

In some embodiments, catalytic and binding domains of the polymerase are joined by a linker domain, e.g., a polypeptide sequence of 1 to about 200 amino acids in length, such as 1 to about 100, 50, 25, or 10 amino acids. In some embodiments, proline residues are incorporated into the linker to prevent the formation of significant secondary structural elements by the linker. Linkers can often be flexible amino acid subsequences that are synthesized as part of a recombinant fusion protein. For a discussion of linkers, see, e.g., US 2011/0086406 A1 including at paragraphs 83-89 thereof.

In some embodiments, the thermophilic DNA polymerase comprises an exonuclease domain. In some embodiments, the exonuclease domain is a 3' to 5' exonuclease domain. The 3'-5' exonuclease domain can have error-correcting activity, also known as proofreading activity, in which the exonuclease preferentially removes a base from a nascent DNA strand/extension product/3' terminus that is not a Watson-Crick match to the template strand. In some embodiments, the 3'-5' exonuclease domain is a DEDDy archaeal exonuclease domain. In some embodiments, the exonuclease domain is N-terminal to the DNA polymerase catalytic domain. In some embodiments, the exonuclease domain is C-terminal to the N-terminal domain comprising a uracil-binding pocket. In some embodiments, the exonuclease domain is N-terminal to the DNA polymerase catalytic domain and C-terminal to the N-terminal domain comprising a uracil-binding pocket. In some embodiments, the thermophilic DNA polymerase comprises a domain having at least 75%, 80%, 85%, 90%, 95%, 98%, 99%, or 100% identity to SEQ ID NO: 63. In some embodiments, the thermophilic DNA polymerase comprises a domain having at least 75%, 80%, 85%, 90%, 95%, 98%, 99%, or 100% identity to the exonuclease domain of a sequence selected from SEQ ID NO: 1, 19, 23, 31, 35, 39, 43, 49, 51, or 52. In some embodiments, the thermophilic DNA polymerase comprises a domain having at least 75%, 80%, 85%, 90%, 95%, 98%, 99%, or 100% identity to the exonuclease domain of SEQ ID NO: 1. In some embodiments, the thermophilic DNA polymerase comprises a domain having at least 75%, 80%, 85%, 90%, 95%, 98%, 99%, or 100% identity to the exonuclease domain of SEQ ID NO: 19. In some embodiments, the thermophilic DNA polymerase comprises a domain having at least 75%, 80%, 85%, 90%, 95%, 98%, 99%, or 100% identity to the exonuclease domain of SEQ ID NO: 23. In some embodiments, the thermophilic DNA polymerase comprises a domain having at least 75%, 80%, 85%, 90%, 95%, 98%, 99%, or 100% identity to the exonuclease domain of SEQ ID NO: 31. In some embodiments, the thermophilic DNA polymerase comprises a domain having at least 75%, 80%, 85%, 90%, 95%, 98%, 99%, or 100% identity to the exonuclease domain of SEQ ID NO: 35. In some embodiments, the thermophilic DNA polymerase comprises a domain having at least 75%, 80%, 85%, 90%, 95%, 98%, 99%, or 100% identity to the exonuclease domain of SEQ ID NO: 39. In some embodiments, the thermophilic DNA polymerase comprises a domain having at least 75%, 80%, 85%, 90%, 95%, 98%, 99%, or 100% identity to the exonuclease domain of SEQ ID NO: 43. In some embodiments, the thermophilic DNA polymerase comprises a domain having at least 75%, 80%, 85%, 90%, 95%, 98%, 99%, or 100% identity to the exonuclease domain of SEQ ID NO: 49. In some embodiments, the thermophilic DNA polymerase comprises a domain having at least 75%, 80%, 85%, 90%, 95%, 98%, 99%, or 100% identity to the exonuclease domain of SEQ ID NO: 51. In some embodiments, the thermophilic DNA polymerase comprises a domain having at least 75%, 80%, 85%, 90%, 95%, 98%, 99%, or 100% identity to the exonuclease domain of SEQ ID NO: 52. An exonuclease domain can be identified using BLASTP against the RefSeq database can be identified by using NCBI BLASTP to search the RefSeq database. NCBI BLASTP automatically identifies certain domains such as exonuclease domains and indicates their termini as the positions at which the domain begins and ends.

In some embodiments, the exonuclease domain is an exonuclease domain of a *Pyrococcus*. In some embodiments, the exonuclease domain is an exonuclease domain of a *Thermococcus*. In some embodiments, the exonuclease domain is an exonuclease domain of a *Pyrobaculum*. In some embodiments, the exonuclease domain is an exonuclease domain of *Pyrococcus furiosus*. In some embodiments, the exonuclease domain is an exonuclease domain of *Pyrococcus* species GB-D. In some embodiments, the exonuclease domain is an exonuclease domain of *Thermococcus kodakarensis*. In some embodiments, the exonuclease domain is an exonuclease domain of *Thermococcus litoralis*. In some embodiments, the exonuclease domain is an exonuclease domain of *Thermococcus gorgonarius*. In some embodiments, the exonuclease domain is an exonuclease domain of *Thermococcus* sp. 9° N-7. In some embodiments, the exonuclease domain is an exonuclease domain of *Pyrobaculum calidifontis*. In some embodiments, the exonuclease domain is an exonuclease domain of *Pyrobaculum aerophilum*.

In some embodiments, the thermophilic DNA polymerase comprises an inactivated or reduced-activity exonuclease domain. An inactivated exonuclease domain is a mutated version of a wild-type domain that has less than 50% of the wild-type exonuclease activity. In some embodiments, the inactivated domain has less than 40%, less than 30%, less than 25%, less than 20%, less than 15%, less than 10%, or less than 5% of the wild-type exonuclease activity. In some embodiments, the inactivated domain has less than 2%, 1%, 0.5%, 0.2%, 0.1%, 0.05%, 0.02%, or 0.01% of the wild-type exonuclease activity. A reduced-activity exonuclease domain is a mutated version of a wild-type domain that has less than 10% of the wild-type exonuclease activity. Measurement of exonuclease activity is described, for example, in *DNA Replication* 2nd, edition, by Kornberg and Baker, W.H. Freeman & Company, New York, N.Y. 1991. Examples of exo⁻ DNA polymerase mutants include those with a single mutation in Motif I and/or II (Motifs are as described, e.g., in U.S. Pat. No. 8,921,043, e.g., at FIG. 2), or a double mutation in Motif I (such as D141A and E143A, the position numbering corresponds to Pfu polymerase, SEQ ID NO: 1), that reportedly abolishes detectable exonuclease activity (see for example, VENT® (*Thermococcus litoralis*) (Kong et al. *J. Biol. Chem.* 268(3):1965-1975) (New England Biolabs, Inc. (NEB), Ipswich, Mass.); *Thermococcus* JDF-3 (U.S. Pat. No. 6,946,273, U.S. 2005/0069908); KODI (*Thermococcus kodakaraensis*) (U.S. Pat. No. 6,008,025); Pfu (*Pyrococcus furiosus*) (U.S. Pat. Nos. 5,489,523, 7,704, 712, and 7,659,100); and 9° N (*Thermococcus* sp.) (U.S. 2005/0123940 and Southworth et al. *Proc Natl Acad Sci USA* 93:5281-5285 (1996)); see also U.S. Pat. No. 8,921, 043. In some embodiments, the exonuclease domain has a D141A, E143A, D215A, D315A, D141A/E143A, D141A/D315A, E143A/D315A, D215A/D315A, or D141A/E143A/D315A mutation. In some embodiments, the exonuclease domain has an A, N, S, T, or E residue at the position corresponding to position 141 of SEQ ID NO: 1. In some embodiments, the exonuclease domain has an A at the position corresponding to position 141 of SEQ ID NO: 1. In some embodiments, the exonuclease domain has an A at the position corresponding to position 143 of SEQ ID NO: 1.

In some embodiments, the amino acid residue at the position of the family B polymerase catalytic domain amino acid sequence that aligns to position 25 of SEQ ID NO: 6 is a serine. In some embodiments, the amino acid residue at the position of the family B polymerase catalytic domain amino acid sequence that corresponds to position 25 of SEQ ID NO: 6 is a serine. In some embodiments, the thermophilic DNA polymerase comprises: (a) the consecutive amino acid residues LDFR<u>S</u> (SEQ ID NO: 196), (b) the consecutive amino acid residues FR<u>S</u>LY (SEQ ID NO: 197), or (c) the consecutive amino acid residues <u>S</u>LYPS (SEQ ID NO: 198), wherein the underlined serine residue is within 30 amino acid residues of the N-terminus of the family B polymerase catalytic domain. In some embodiments, the thermophilic DNA polymerase comprises:
(a) the consecutive amino acid residues LDFRS* (SEQ ID NO: 196), (b) the consecutive amino acid residues FRS*LY (SEQ ID NO: 197), or (c) the consecutive amino acid residues S*LYPS (SEQ ID NO: 198), wherein the serine residue immediately followed by an asterisk is within 30 amino acid residues of the N-terminus of the family B polymerase catalytic domain. The asterisk is included solely to designate the serine that is within 30 amino acid residues of the N-terminus of the family B polymerase catalytic domain and does not signify a structural difference. In some embodiments, the N-terminus of the family B polymerase catalytic domain is the residue immediately preceding the conserved tyrosine shown as the second residue in the multiple sequence alignment in FIG. 12. In some embodiments, the N-terminus of the family B polymerase catalytic domain is the position immediately preceding the position corresponding to the first tyrosine in SEQ ID NO: 6. In some embodiments, the N-terminus of the family B polymerase catalytic domain is the position that aligns to position 1 of SEQ ID NO: 6. In some embodiments, the N-terminus of the family B polymerase catalytic domain is the position corresponding to the position immediately preceding a tyrosine selected from the tyrosines shown as the second residues in FIG. 12. In some embodiments, the N-terminus of the family B polymerase catalytic domain is the position immediately preceding the position that aligns to a tyrosine selected from the tyrosines shown as the second residues in FIG. 12. In some embodiments, the N-terminus of the family B polymerase catalytic domain is the position immediately preceding the position corresponding to a tyrosine selected from the tyrosines shown as the second residues in FIG. 12. The N-terminal residue in any of the foregoing embodiments can be a serine. The N-terminal residue in any of the foregoing embodiments can be a threonine. The N-terminal residue in any of the foregoing embodiments can be a glycine. The N-terminal residue in any of the foregoing embodiments can be a proline.

As will be apparent from various aspects of the discussion above, family B polymerases are well-characterized in general and are known to tolerate mutations at a number of positions. Furthermore, the following is a non-exhaustive list of patents and published applications that discuss mutations in family B polymerases and the properties of mutated family B polymerases: U.S. Pat. Nos. 8,435,775; 8,557,554; WO2007/016702; US 2003/0180741; WO 2004/011605; WO 2003/060144; and U.S. Pat. No. 9,023,633. Accordingly, those skilled in the art will understand in view of this disclosure that the residues discussed herein such as the neutral amino acid at the position corresponding to position 379 of SEQ ID NO: 6 can be incorporated into a wide variety of thermophilic family B polymerases and can be accompanied by other amino acid residues that differ from wild-type residues. Thus, in some embodiments, the thermophilic DNA polymerase comprises an amino acid sequence comprising at least one difference from SEQ ID NO: 1 at a position corresponding to position 15, 72, 93, 141, 143, 247, 265, 337, 385, 387, 388, 399, 400, 405, 407, 410, 485, 542, 546, 593, or 595 of SEQ ID NO: 1. In some embodiments, the thermophilic DNA polymerase comprises an amino acid sequence comprising at least one missing residue corresponding to position 92, 93, 94, or 381 of SEQ ID NO: 1. In some embodiments, the at least one difference or missing residue is in the exonuclease domain. In some embodiments, the at least one difference or missing residue is in the polymerase catalytic domain.

In some embodiments, the polymerase with the at least one difference or missing residue has an expanded substrate range relative to a polymerase without the difference or in which the residue is not missing. In some embodiments, the at least one difference comprises a G or D at the position corresponding to position 400 of SEQ ID NO: 1. In some embodiments, the at least one difference comprises an I at the position corresponding to position 407 of SEQ ID NO: 1. In some embodiments, the at least one difference comprises an I at the position corresponding to position 337 of SEQ ID NO: 1. In some embodiments, the at least one difference comprises a D at the position corresponding to position 399 of SEQ ID NO: 1. In some embodiments, the at least one difference comprises an H at the position corresponding to position 546 of SEQ ID NO: 91.

In some embodiments, the polymerase with the at least one difference or missing residue incorporates a nucleotide analog to a greater extent than a polymerase without the difference or in which the residue is not missing. In some embodiments, the at least one difference comprises an L at the position corresponding to position 410 of SEQ ID NO: 1. In some embodiments, the at least one difference comprises a T at the position corresponding to position 485 of SEQ ID NO: 1.

In some embodiments, the polymerase with the at least one difference or missing residue has reduced uracil sensitivity relative to a polymerase without the difference or in which the residue is not missing. In some embodiments, the at least one missing residue comprises a missing residue at the position corresponding to position 93 of SEQ ID NO: 1. In some embodiments, the at least one missing residue comprises a missing residue at the position corresponding to position 94 of SEQ ID NO: 1. In some embodiments, the at least one missing residue comprises a missing residue at the position corresponding to position 92 of SEQ ID NO: 1. In some embodiments, the at least one difference comprises a Q, R, E, A, K, N, or G at the position corresponding to position 93 of SEQ ID NO: 1. In some embodiments, the at least one difference comprises a Q or R at the position corresponding to position 93 of SEQ ID NO: 1. In some embodiments, an at least one difference or missing residue as discussed above in this paragraph is accompanied by at least one difference or missing residue that offsets a loss of activity. In some embodiments, the at least one difference that offsets a loss of activity comprises an R at the position corresponding to position 247 of SEQ ID NO: 1. In some embodiments, the at least one difference that offsets a loss of activity comprises an R at the position corresponding to position 265 of SEQ ID NO: 1. In some embodiments, the at least one difference that offsets a loss of activity comprises an R at the position corresponding to position 485 of SEQ ID NO: 1. In some embodiments, the at least one missing residue that offsets a loss of activity comprises a missing residue at the position corresponding to position 381 of SEQ ID NO: 1.

In some embodiments, the at least one difference comprises an R at the position corresponding to position 247 of SEQ ID NO: 1. In some embodiments, the at least one difference comprises an R at the position corresponding to position 265 of SEQ ID NO: 1. In some embodiments, the at least one difference comprises an R at the position corresponding to position 485 of SEQ ID NO: 1. In some embodiments, the at least one missing residue comprises a missing residue at the position corresponding to position 381 of SEQ ID NO: 1. In some embodiments, the at least one difference comprises an I at the position corresponding to position 15 of SEQ ID NO: 1. In some embodiments, the at least one difference comprises an R at the position corresponding to position 72 of SEQ ID NO: 1.

In some embodiments, the polymerase with the at least one difference or missing residue has an altered proofreading spectrum relative to a polymerase without the difference or in which the residue is not missing. In some embodiments, the at least one difference comprises a P or S at the position corresponding to position 387 of SEQ ID NO: 1. In some embodiments, the at least one difference comprises an E at the position corresponding to position 405 of SEQ ID NO: 1. In some embodiments, the at least one difference comprises an F at the position corresponding to position 410 of SEQ ID NO: 1. In some embodiments, the at least one difference comprises a P at the position corresponding to position 542 of SEQ ID NO: 1. In some embodiments, the at least one difference comprises a T at the position corresponding to position 593 of SEQ ID NO: 1. In some embodiments, the at least one difference comprises an S at the position corresponding to position 595 of SEQ ID NO: 1. In some embodiments, the at least one difference comprises a Q, S, N, L, or H at the position corresponding to position 385 of SEQ ID NO: 1. In some embodiments, the at least one difference comprises a P at the position corresponding to position 388 of SEQ ID NO: 1.

In some embodiments, the thermophilic DNA polymerase comprises an amino acid sequence having at least 90%, 95%, 98%, 99%, or 100% identity to a sequence selected from SEQ ID NOs: 11 to 14, 19 to 22, 27 to 30, and 76 to 79. In some embodiments, the thermophilic DNA polymerase comprises an amino acid sequence having at least 90%, 95%, 98%, 99%, or 100% identity to SEQ ID NO: 11. In some embodiments, the thermophilic DNA polymerase comprises an amino acid sequence having at least 90%, 95%, 98%, 99%, or 100% identity to SEQ ID NO: 12. In some embodiments, the thermophilic DNA polymerase comprises an amino acid sequence having at least 90%, 95%, 98%, 99%, or 100% identity to SEQ ID NO: 13. In some embodiments, the thermophilic DNA polymerase comprises an amino acid sequence having at least 90%, 95%, 98%, 99%, or 100% identity to SEQ ID NO: 14. In some embodiments, the thermophilic DNA polymerase comprises an amino acid sequence having at least 90%, 95%, 98%, 99%, or 100% identity to SEQ ID NO: 19. In some embodiments, the thermophilic DNA polymerase comprises an amino acid sequence having at least 90%, 95%, 98%, 99%, or 100% identity to SEQ ID NO: 20. In some embodiments, the thermophilic DNA polymerase comprises an amino acid sequence having at least 90%, 95%, 98%, 99%, or 100% identity to SEQ ID NO: 21. In some embodiments, the thermophilic DNA polymerase comprises an amino acid sequence having at least 90%, 95%, 98%, 99%, or 100% identity to SEQ ID NO: 22. In some embodiments, the thermophilic DNA polymerase comprises an amino acid sequence having at least 90%, 95%, 98%, 99%, or 100% identity to SEQ ID NO: 27. In some embodiments, the thermophilic DNA polymerase comprises an amino acid sequence having at least 90%, 95%, 98%, 99%, or 100% identity to SEQ ID NO: 28. In some embodiments, the thermophilic DNA polymerase comprises an amino acid sequence having at least 90%, 95%, 98%, 99%, or 100% identity to SEQ ID NO: 29. In some embodiments, the thermophilic DNA polymerase comprises an amino acid sequence having at least 90%, 95%, 98%, 99%, or 100% identity to SEQ ID NO: 30. In some embodiments, the thermophilic DNA polymerase comprises an amino acid sequence having at least 90%, 95%, 98%, 99%, or 100% identity to SEQ ID NO: 76. In some embodiments, the thermophilic DNA polymerase comprises an amino acid sequence having at least 90%, 95%, 98%, 99%, or 100% identity to SEQ ID NO: 77. In some embodiments, the thermophilic DNA polymerase comprises an amino acid sequence having at least 90%, 95%, 98%, 99%, or 100% identity to SEQ ID NO: 78. In some embodiments, the thermophilic DNA polymerase comprises an amino acid sequence having at least 90%, 95%, 98%, 99%, or 100% identity to SEQ ID NO: 79.

In some embodiments, the polymerase comprises an affinity purification tag. In some embodiments, the affinity purification tag comprises a sequence of histidines, such as 6, 7, 8, 9, or 10 consecutive histidines (SEQ ID NO: 218). The affinity purification tag can be located, e.g., at the N or C terminus of a polypeptide of the polymerase.

Hot Start Enzymes and Compositions

In some embodiments, a polymerase according to this disclosure is provided as a hot-start enzyme or a hot start composition. For discussion of hot-start enzymes and/or compositions, see, e.g., U.S. Pat. Nos. 5,338,671; 7,074,556; US Publication 2015/0044683; US Publication 2014/0099644. As used herein, the term "hot start" generally refers to a means of limiting the availability of an essential reaction component (e.g., a polymerase) when the reaction mixture is maintained at a first temperature (typically a lower temperature) until a second temperature (typically a higher temperature) is reached which allows the essential component to participate in the reaction. Hot start reactions typically involve incubation at a first (e.g., lower) temperature and subsequent elevation to a second (e.g., higher) temperature which allows the desired reaction to take place. Activation of the hot start reaction is preferably achieved by an incubation at a temperature which is equal to or higher than the primer hybridization (annealing) temperature used in the amplification reaction to ensure primer binding specificity. The length of incubation required to recover enzyme activity depends on the temperature and pH of the reaction mixture and on the stability of the enzyme. A wide range of incubation conditions are usable; optimal conditions may be determined empirically for each reaction.

As used herein, the term "dual hot start reaction mixture" refers to the combination of reagents or reagent solutions which are used to block nucleic acid polymerase extension at low temperatures (e.g., ambient temperature) until the hot start conditions of the initial denaturation temperature in an amplification reaction (e.g., PCR) are reached. At the elevated amplification temperature, the nucleic acid polymerase is no longer inhibited and allows for primer extension. As used herein, the dual hot start reaction mixture is meant to include a reaction mixture that comprises at least two different mechanisms for hot start. Accordingly, "dual hot start reaction mixtures" may include more than two hot start mechanisms (e.g., "triple hot start reaction mixture", "quadruple hot start reaction mixture", "quintuple hot start reaction mixture", and so on).

Nonlimiting exemplary hot start mechanisms include, but are not limited to, antibodies or combinations of antibodies that block nucleic acid polymerase activity at lower temperatures and which dissociate from the polymerase at elevated temperatures (see, e.g., Eastlund et al., *LifeSci. Quarterly* 2:2 (2001), Mizuguchi et al., *J. Biochem.* (Tokyo) 126:762 (1999)); affibodies (small synthetic protein molecules that have high binding affinity for a target protein) or combinantions of affibodies, sometimes referred to as antibody mimetics; oligonucleotides that block nucleic acid polymerase activity at lower temperatures and which dissociate from the polymerase at elevated temperatures (see, e.g., Dang et al., *J. Mol. Biol.* 264:268 (1996)); reversible chemical modification of the nucleic acid polymerase such that the nucleic acid polymerase activity is blocked at lower temperatures and the modifications reverse or dissociate at elevated temperatures (see, e.g., U.S. Pat. No. 5,773,258 and Moretti et al., *Biotechniques* 25:716 (1998)); amino acid mutations of the nucleic acid polymerase that provide reduced activity at lower temperatures (see, e.g., Kermekchiev et al., *Nucl. Acids Res.* 31:6139 (2003)); nucleic acid polymerase fusion proteins including hyperstable DNA binding domains and topoisomerases (see, e.g., Pavlov et al., *Proc. Natl. Acad. Sci. USA* 99:13510 (2002)); ligands that inhibit the nucleic acid polymerase in a temperature-dependent manner (for example, HotMaster™ Taq DNA polymerase from Eppendorf (Hauppauge, N.Y.) and 5 PRIME (Gaithersburg, Md.)); single-stranded binding proteins that sequester primers at low temperatures (see, e.g., U.S. Patent Application Publication No. 2008/0138878); thermostable pyrophosphatase which hydrolyzes inorganic pyrophosphate at elevated temperatures (see, e.g., U.S. Patent Application Publication No. 2006/0057617); thermolabile blockers, such as a polymerase blocking protein (see, e.g., U.S. Patent Application Publication No. 2007/0009922); primer competitor sequences (see, e.g., Puskas et al., *Genome Res.* 5:309 (1995) and Vestheim et al., *Front. Zool.* 5:12 (2008)); modified primer constructs (see, e.g., Ailenberg et al., *Biotechniques* 29:22 (2000) and Kaboev et al., *Nucl. Acids Res.* 28:E94 (2000)); modified primers that improve hybridization selectivity (see, e.g., U.S. Pat. Nos. 6,794,142 and 6,001,611); primers with 3' modifications that are removable by 3'-5' exonuclease activity (see, e.g., U.S. Patent Application Publication No. 2003/0119150 and U.S. Pat. No. 6,482,590); primers with modified nucleobases that are removable by UV irradiation (see, e.g., Young et al., *Chem. Commun.* (Camb) 28:462 (2008)); primer modifications that are removable by thermal deprotection (see, e.g., U.S. Patent Application Publication No. 2003/0162199 and Lebedev et al., *Nucl. Acids Res.* 36:e131 (2008)); or modification of the dNTPs with thermolabile modification groups (see, e.g., U.S. Patent Application Publication No. 2003/0162199 and Koukhareva et al., *Nucl. Acids Symp. Ser.* (Oxford), 259 (2008)). Agents that are used as hot start mechanisms, such as antibodies, oligonucleotides, affibodies, chemical modifications, etc., may be referred to as "hot start inhibitors."

In some embodiments, the hot start composition comprises an antibody specific for the polymerase. In some embodiments, the hot start composition comprises an antibody specific for the polymerase, which is bound to the polymerase. In some embodiments, the hot start composition comprises an inhibitor specific for the polymerase, which is bound to the polymerase. In some embodiments, the inhibitor comprises an Affibody®. Affibodies are described, e.g., in US Publication 2012/0082981; see also Nord et al., 2000, *J. Biotechnol.* 80: 45-54; U.S. Pat. No. 6,602,977; Nygren, 2008, *FEBS J.* 275: 2668-2676; Nord et al., 1997, 15: 772-777; U.S. Pat. No. 5,831,012. In some embodiments, the inhibitor comprises an oligonucleotide. In some embodiments, the inhibitor comprises a chemical modification.

As used herein, dual hot start reaction mixtures comprising "at least two different mechanisms" encompass those reaction mixtures that may comprise at least two different hot start mechanisms that function similarly or use similar components. For example, dual hot start reaction mixtures can comprise reagents or reagent solutions designed for two different antibody-based hot start mechanisms, or two different oligonucleotide-based hot start mechanisms, or one antibody-based and one oligonucleotide-based hot start mechanism, or one antibody-based and one chemical modification-based hot start mechanism, or any such combination available.

Hot Start Antibodies and Methods of Making Same

In some embodiments, a hot start composition or dual hot start composition comprises an antibody inhibitor of a thermostable polymerase described herein. In some embodiments, the antibody is a monoclonal antibody.

Methods for producing and screening for antibodies that are suitable for use in hot start compositions with the polymerases described herein are known in the art. In some embodiments, a hot start antibody inhibits the nucleic acid synthesis activity of the thermostable polymerase described herein. In some embodiments, a hot start antibody inhibits exonuclease activity of the thermostable polymerase. In some embodiments, a hot start antibody inhibits both the nucleic acid synthesis activity and the exonuclease activity of the thermostable polymerase.

In some embodiments, hot-start antibodies increase the specificity of nucleic acid synthesis reactions, because they inactivate the polymerase at room temperature, thus avoiding extension of nonspecifically hybridized primers. The functional activity of the polymerase is restored by disassociating the antibody from the polymerase, for example, by incubating the composition at a higher temperature. In some embodiment, the "higher temperature" is from about 65° C. to about 99° C., from about 70° C. to about 99° C., 75° C. to about 99° C., or from about 80° C. to about 99° C., or from about 85° C. to about 99° C., or from about 90° C. to about 99° C., for a time period of at least 15 seconds, or at least 30 seconds, or at least 1 minute, or at least 90 seconds, or at least 2 minutes; to about 3 minutes, or about 4 minutes, or about 5 minutes, or about 7 minutes, or about 10 minutes, or more. In some embodiments, the higher temperature is at least 60° C., at least 65° C., at least 70° C., at least 75° C., at least 80° C., or at least 85° C. In some embodiments, the temperature and duration of incubation to disassociate the antibody and activate the polymerase may be determined for the particular polymerase and antibody to be employed.

Methods for screening for antibodies of use in the present invention include methods known in the art, such as affinity-based ELISA assays, as well as functional assays for polymerase and/or exonuclease inhibition. For such functional assays, the amount of DNA produced or digested per unit of time can be correlated to the activity of the polymerase or exonuclease used, thus providing an estimate of the amount of inhibition a particular antibody can exert on either or both the polymerase and exonuclease activity of the polymerase.

Antibodies may be produced using any method known in the art. As a non-limiting example, an antibody to a particular antigen (such as a polymerase described herein) may be produced by immunizing an animal (such as a mouse, rat, rabbit, goat, sheep, horse, etc.) with the antigen and isolating antibodies from the serum of the animal and/or immortalizing primary B cells from the animal to produce hybridomas that express the antibodies. Phage display technology may also be used to produce antibodies that bind to the polymerases described herein. Phage display libraries are commercially available and methods of selecting antibodies from such libraries are known in the art. See, e.g., Vaughan et al., 1996, Nature Biotechnology, 14:309-314; Sheets et al., 1998, Proc. Natl. Acad. Sci. (USA) 95:6157-6162; Hoogenboom and Winter, 1991, J. Mol. Biol., 227:381; Marks et al., 1991, J. Mol. Biol., 222:581.

Exemplary Assays to Determine Polymerase Processivity, Yield, Sensitivity, and Specificity Polymerase processivity may be measured using various methods known in the art. In some embodiments, processivity refers to the number of nucleotides incorporated during a single binding event of polymerase to a primed template. As a nonlimiting example, a detectably labeled primer may be annealed to circular or linearized DNA to form a primed nucleic acid template. In measuring processivity, the primed nucleic acid template may be present in significant molar excess to the polymerase to reduce the likelihood that any one primed template will be extended more than once by a polymerase. A "significant molar excess" may be, for example, a ratio of 500:1, or 1000:1, or 2000:1, or 4000:1, or 5000:1 (primed DNA:DNA polymerase), etc., in the presence of suitable buffers and dNTPs. Nucleic acid synthesis may be initiated by adding, for example, $MgCl_2$. Nucleic acid synthesis reactions are quenched at various times after initiation, and analyzed by any appropriate method to determine the length of the product. At a polymerase concentration where the median product length does not change with time or polymerase concentration, the length corresponds to the processivity of the enzyme. In some embodiments, the processivity of a polymerase described, such as a polymerase comprising a neutral amino acid at position corresponding to position 762 of SEQ ID NO: 1 may be compared to the processivity of the same polymerase without the neutral amino acid mutation.

In some embodiments, yield can be demonstrated by measuring the ability of a polymerase to produce product. Increased yield can be demonstrated by determining the amount of product obtained in a reaction using a polymerase described herein (such as a polymerase comprising a neutral amino acid at position corresponding to position 762 of SEQ ID NO: 1), as compared to the amount of product obtained in a reaction carried out under the same reaction conditions, but with the same polymerase without the neutral amino acid mutation.

In some embodiments, long PCR may be used to determine enhanced processivity and yield. For example, an enzyme with enhanced processivity typically allows the amplification of a longer amplicons (>5 kb) in shorter extension times compared to an enzyme with relatively lower processivity.

Other methods of assessing efficiency of the polymerases of the invention can be determined by those of ordinary skill in the art using standard assays of the enzymatic activity of a given modification enzyme.

The sensitivity of a polymerase described herein may be determined by measuring the yield of nucleic acid synthesis product in a series of reactions with differing copy numbers of nucleic acid template. In some embodiments, the template copy number at which a polymerase of the invention (such as a polymerase comprising a neutral amino acid at position corresponding to position 762 of SEQ ID NO: 1) produces detectable product is compared to the template copy number at which the same polymerase without the neutral amino acid mutation produces detectable product. The lower the template copy number at which the polymerase produces detectable product, the more sensitive the polymerase.

In some embodiments, specificity of a polymerase may be measured by determining the ability of the polymerase to discriminate between matched primer/template duplexes and mismatched primer/template duplexes. In some embodiments, specificity is a measure of the difference in the relative yield of two reactions, one of which employs a matched primer, and one of which employs a mismatched primer. In some embodiments, an enzyme with increased discrimination will have a higher relative yield with the matched primer than with the mismatched primer. In some embodiments, a ratio of the yield with the matched primer versus the mismatched primer is determined. In some embodiments, the ratio can be compared to the yield obtained under the same reaction conditions using the parental polymerase.

DNA Synthesis Methods; Kits, Compositions, Systems, and Apparatuses.

Provided herein are methods of synthesizing or amplifying DNA and related kits, compositions, systems, and apparatuses involving at least one polymerase according to this disclosure. In some embodiments, reagents for nucleic acid synthesis are provided. In some embodiments, reagents for nucleic acid synthesis include any one or any combination of target polynucleotides, particles attached with capture primers, solution-phase primers, fusion primers, other additional primers, enzymes (e.g., polymerases), accessory proteins (e.g., recombinase, recombinase loading protein, single-stranded binding protein, helicase or topoisomerase), nucleotides, divalent cations, binding partners, co-factors and/or buffer. In some embodiments, reagents for nucleic acid synthesis include a dUTPase as an accessory protein.

In some embodiments, the disclosure relates generally to compositions, as well as related systems, methods, kits and apparatuses, comprising one or more nucleotides. In some embodiments, the compositions (and related methods, systems, kits and apparatuses) includes one type, or a mixture of different types of nucleotides. A nucleotide comprises any compound that can bind selectively to, or can be polymerized by, a polymerase. Typically, but not necessarily, selective binding of the nucleotide to the polymerase is followed by polymerization of the nucleotide into a nucleic acid strand by the polymerase. Such nucleotides include not only naturally occurring nucleotides but also any analogs, regardless of their structure, that can bind selectively to, or can be polymerized by, a polymerase. While naturally occurring nucleotides typically comprise base, sugar and phosphate moieties, the nucleotides of the present disclosure can include compounds lacking any one, some or all of such moieties. In some embodiments, the nucleotide can optionally include a chain of phosphorus atoms comprising three, four, five, six, seven, eight, nine, ten or more phosphorus atoms. In some embodiments, the phosphorus chain can be attached to any carbon of a sugar ring, such as the 5' carbon. The phosphorus chain can be linked to the sugar with an intervening O or S. In some embodiments, one or more phosphorus atoms in the chain can be part of a phosphate group having P and O. In some embodiments, the phosphorus atoms in the chain can be linked together with intervening O, NH, S, methylene, substituted methylene, ethylene, substituted ethylene, CNH2, C(O), C(CH2), CH2CH2, or C(OH)CH2R (where R can be a 4-pyridine or 1-imidazole). In some embodiments, the phosphorus atoms in the chain can have side groups having O, BH3, or S. In the phosphorus chain, a phosphorus atom with a side group other than O can be a substituted phosphate group. In the phosphorus chain, phosphorus atoms with an intervening atom other than O can be a substituted phosphate group. Some examples of nucleotide analogs are described in Xu, U.S. Pat. No. 7,405,281.

Some examples of nucleotides that can be used in the disclosed compositions (and related methods, systems, kits and apparatuses) include, but are not limited to, ribonucleotides, deoxyribonucleotides, modified ribonucleotides, modified deoxyribonucleotides, ribonucleotide polyphosphates, deoxyribonucleotide polyphosphates, modified ribonucleotide polyphosphates, modified deoxyribonucleotide polyphosphates, peptide nucleotides, modified peptide nucleotides, metallonucleosides, phosphonate nucleosides, and modified phosphate-sugar backbone nucleotides, analogs, derivatives, or variants of the foregoing compounds, and the like. In some embodiments, the nucleotide can comprise non-oxygen moieties such as, for example, thio- or borano-moieties, in place of the oxygen moiety bridging the alpha phosphate and the sugar of the nucleotide, or the alpha and beta phosphates of the nucleotide, or the beta and gamma phosphates of the nucleotide, or between any other two phosphates of the nucleotide, or any combination thereof. In some embodiments, a nucleotide can include a purine or pyrimidine base, including adenine, guanine, cytosine, thymine, uracil or inosine. In some embodiments, a nucleotide includes dATP, dGTP, dCTP, dTTP and dUTP.

In some embodiments, the nucleotide is unlabeled. In some embodiments, the nucleotide comprises a label and referred to herein as a "labeled nucleotide". In some embodiments, the label can be in the form of a fluorescent dye attached to any portion of a nucleotide including a base, sugar or any intervening phosphate group or a terminal phosphate group, i.e., the phosphate group most distal from the sugar.

In some embodiments, the disclosure relates generally to compositions, as well as related systems, methods, kits and apparatuses, comprising any one or any combination of capture primers, reverse solution-phase primers, fusion primers, target polynucleotides and/or nucleotides that are non-labeled or attached to at least one label. In some embodiments, the label comprises a detectable moiety. In some embodiments, the label can generate, or cause to generate, a detectable signal. In some embodiments, the detectable signal can be generated from a chemical or physical change (e.g., heat, light, electrical, pH, salt concentration, enzymatic activity, or proximity events). For example, a proximity event can include two reporter moieties approaching each other, or associating with each other, or binding each other. In some embodiments, the detectable signal can be detected optically, electrically, chemically, enzymatically, thermally, or via mass spectroscopy or Raman spectroscopy. In some embodiments, the label can include compounds that are luminescent, photoluminescent, electroluminescent, bioluminescent, chemiluminescent, fluorescent, phosphorescent or electrochemical. In some embodiments, the label can include compounds that are fluorophores, chromophores, radioisotopes, haptens, affinity tags, atoms or enzymes. In some embodiments, the label comprises a moiety not typically present in naturally occurring nucleotides. For example, the label can include fluorescent, luminescent or radioactive moieties.

In some embodiments, the nucleic acid synthesis reaction includes a cycled amplification reaction, such as a polymerase chain reaction (PCR) (U.S. Pat. Nos. 4,683,195 and 4,683,202 both granted to Mullis). Multiple examples of PCR according to this disclosure are provided below. In some embodiments, the nucleic acid synthesis reaction includes an isothermal reaction, such as an isothermal self-sustained sequence reaction (Kwoh 1989 Proceedings National Academy of Science USA 86:1173-1177; WO 1988/10315; and U.S. Pat. Nos. 5,409,818, 5,399,491, and 5,194,370), or a recombinase polymerase amplification (RPA) (U.S. Pat. No. 5,223,414 to Zarling, U.S. Pat. Nos. 5,273,881 and 5,670,316 both to Sena, and U.S. Pat. Nos. 7,270,981, 7,399,590, 7,435,561, 7,666,598, 7,763,427, 8,017,339, 8,030,000, 8,062,850, and 8,071,308).

PCR is a nucleic acid synthesis reaction in which the reaction mixture is subjected to reaction cycles, each reaction cycle comprising a denaturation period and at least one annealing and/or extension period, resulting if successful in synthesis of copies of a nucleic acid template in at least the initial cycles, and copies of the copies in at least the later cycles, generally resulting in exponential amplification of the template. In PCR, in some instances, a pair of primers are provided that bind at each end of a target region, on opposite strands such that they each prime synthesis toward the other primer. The reaction is thermocycled so as to drive denaturation of the substrate in a high temperature step, annealing of the primers at a lower temperature step, and extension at a temperature which may be but is not necessarily higher than that of the annealing step. Exponential amplification occurs because the products of one cycle can serve as template in the next cycle.

An embodiment of isothermal self-sustained sequence reaction, also sometimes referred to as transcription-mediated amplification or TMA, involves synthesizing single-stranded RNA, single-stranded DNA and double-stranded DNA. The single-stranded RNA is a first template for a first primer, the single-stranded DNA is a second template for a second primer, and the double stranded DNA is a third template for synthesis of a plurality of copies of the first template. A sequence of the first primer or the second primer is complementary to a sequence of a target nucleic acid and a sequence of the first primer or the second primer is homologous to a sequence of the target nucleic acid. In an embodiment of an isothermal self-sustained sequence reaction, a first cDNA strand is synthesized by extension of the first primer along the target by an enzyme with RNA-dependent DNA polymerase activity, such as a reverse transcriptase. The first primer can comprise a polymerase binding sequence (PBS) such as a PBS for a DNA-dependent RNA polymerase, such as T7, T3, or SP6 RNA polymerase. The first primer comprising a PBS is sometimes referred to as a promoter-primer. The first cDNA strand is rendered single-stranded, such as by denaturation or by degradation of the RNA, such as by an RNase H. The second primer then anneals to the first cDNA strand and is extended to form a second cDNA strand by a DNA polymerase activity. Forming the second cDNA strand renders the cDNA double-stranded, including the PBS. RNA can then be synthesized from the cDNA, which comprises the PBS, by a DNA-dependent RNA polymerase, such as T7, T3, or SP6 RNA polymerase, thereby providing a template for further events (extension of the first primer, rendering the product single-stranded, extension of the second primer, and RNA synthesis). Exponential amplification occurs because the RNA product can subsequently serve as a template and also because RNA products can be generated repeatedly from a cDNA comprising the PBS.

An embodiment of RPA can be performed isothermally and employs a recombinase to promote strand invasion of a double-stranded template by forward and reverse primers.

The 3' ends of the primers are extended, displacing template strands at least in part. Subsequent strand invasion/annealing events, including to previously produced extension products, occur and are followed by extension, resulting in amplification. In some embodiments, recombinase activity is supported by the presence of one or more recombinase accessory proteins, such as a recombinase loading protein and/or single-stranded binding protein.

In some embodiments, the disclosure relates generally to compositions, and related methods, systems, kits and apparatuses, comprising a nucleic acid synthesis reaction (synthesis condition) that can be conducted under thermocycling or isothermal conditions, or a combination of both types of conditions. For example, the synthesis condition can include alternating between thermocycling and isothermal synthesis conditions, in any order.

In some embodiments thermocycling synthesis conditions comprise a nucleic acid synthesis reaction mixture that is subjected to an elevated temperature for a period of time that is sufficient to denature at least about 30-95% of the double-stranded target nucleic acids, and then subjected to a lower temperature for a period of time that is sufficient to permit hybridization between the single-stranded target nucleic acids and any of the primers (e.g., capture primer, reverse solution-phase primer, or fusion primer). In some embodiments, the increase and decrease temperature cycle is repeated at least once.

In some embodiments isothermal synthesis conditions comprise a nucleic acid synthesis reaction mixture that is subjected to a temperature variation which is constrained within a limited range during at least some portion of the synthesis, including for example a temperature variation is within about 20° C., or about 10° C., or about 5° C., or about 1-5° C., or about 0.1-1° C., or less than about 0.1° C.

In some embodiments, an isothermal nucleic acid synthesis reaction can be conducted for about 2, 5, 10, 15, 20, 30, 40, 50, 60 or 120 minutes, or longer. In some embodiments, an isothermal nucleic acid synthesis reaction can be conducted for at least about 2 minutes. In some embodiments, an isothermal nucleic acid synthesis reaction can be conducted for about 120 minutes or less. In some embodiments, an isothermal nucleic acid synthesis reaction can be conducted for about 2 to about 120 minutes. In some embodiments, an isothermal nucleic acid synthesis reaction can be conducted for about 2 to about 60 minutes. In some embodiments, an isothermal nucleic acid synthesis reaction can be conducted for about 60 to about 120 minutes. In some embodiments, an isothermal nucleic acid synthesis reaction can be conducted for about 2 to about 5 minutes. In some embodiments, an isothermal nucleic acid synthesis reaction can be conducted for about 5 to about 10 minutes. In some embodiments, an isothermal nucleic acid synthesis reaction can be conducted for about 10 to about 15 minutes. In some embodiments, an isothermal nucleic acid synthesis reaction can be conducted for about 10 to about 15 minutes. In some embodiments, an isothermal nucleic acid synthesis reaction can be conducted for about 10 to about 15 minutes. In some embodiments, an isothermal nucleic acid synthesis reaction can be conducted for about 15 to about 20 minutes. In some embodiments, an isothermal nucleic acid synthesis reaction can be conducted for about 20 to about 30 minutes. In some embodiments, an isothermal nucleic acid synthesis reaction can be conducted for about 30 to about 40 minutes. In some embodiments, an isothermal nucleic acid synthesis reaction can be conducted for about 40 to about 50 minutes. In some embodiments, an isothermal nucleic acid synthesis reaction can be conducted for about 50 to about 60 minutes.

In some embodiments, an isothermal nucleic acid synthesis reaction can be conducted at about 15-30° C., or about 30-45° C., or about 45-60° C., or about 60-75° C., or about 75-90° C., or about 90-93° C., or about 93-99° C.

In some embodiments, the disclosure relates generally to methods, and related compositions, systems, kits and apparatuses, that further include an enrichment step. In some embodiments, an enrichment step comprises a pre-amplification reaction. See, e.g., U.S. Pat. No. 8,815,546 B2. As a nonlimiting example, a pre-amplification reaction may comprise random primers to amplify a portion, even a substantial portion, of the nucleic acid template in a sample. In this manner, the overall amount of nucleic acid template may be increased prior to a sequence-specific nucleic acid synthesis reaction.

In some embodiments, an amplified population of nucleic acids can include an affinity moiety. For example, in conducting any of the nucleic acid synthesis methods according to the present teachings, a solution-phase/reverse primer that is attached to an affinity moiety (e.g., biotin) can be used to conduct a synthesis reaction to produce an amplified population of nucleic acids that are attached to the affinity moiety. In some embodiments, the enrichment step comprises forming a enrichment complex by binding the affinity moiety (which is attached to the amplified population of nucleic acids) with a purification particle (e.g., paramagnetic bead) that is attached to a receptor moiety (e.g., streptavidin). An example of purification particles include MyOne™ Beads from Dynabeads, which are paramagnetic beads attached to streptavidin. In some embodiments, a magnet can be used to separate/remove the enrichment complex from amplified population of nucleic acids that lack the affinity moiety. In some embodiments, the enrichment step can be repeated at least once. In some embodiment, the enrichment step is followed by one or more washing step.

In some embodiments, the disclosure relates generally to methods, and related compositions, systems, kits and apparatuses that further include at least one washing step. The washing step can be conducted at any time during the workflow for nucleic acid synthesis. In some embodiments, a washing step can remove excess or unreacted components of the nucleic acid synthesis or enrichment reactions.

In some embodiments, any of the nucleic acid synthesis methods, or enrichment steps, according to the present teachings, can be conducted manually or by automation. In some embodiments, any one or any combination of the steps can be conducted manually or by automation, including: conducting a nucleic acid synthesis reaction, enriching, and/or washing. For example, any reagents for a nucleic acid synthesis, enrichment or washing, can be deposited into, or removed from, a reaction vessel via manual or automated modes.

In various embodiments, the disclosure relates to compositions comprising at least one polymerase described herein. In some embodiments, the composition is a hot start composition. In some such embodiments, the composition is a dual hot start composition. In some embodiments, the dual hot start composition comprises at least two different hot start mechanisms that are used to inhibit or substantially inhibit the polymerase activity at a first temperature. Such hot start mechanisms include, but are not limited to, antibodies or combinations of antibodies that block DNA polymerase activity at lower temperatures, antibody mimetics or combinations of antibody mimetics that block DNA polymerase activity at lower temperatures (such as, for example, Affibodies®), oligonucleotides that block DNA polymerase activity at lower temperatures (such as, for example, aptamers), reversible chemical modifications of the DNA polymerase that dissociate at elevated temperatures, amino acid modifications of the DNA polymerase that provide reduced activity at lower temperatures, fusion proteins that include hyperstable DNA binding domains and topoisomerase, other temperature dependent ligands that inhibit the DNA polymerase, single stranded binding proteins that sequester primers at lower temperatures, modified primers or modified dNTPs. Hot start compositions, in some embodiments, comprise at least one polymerase described herein with or without a hot start chemical modification, at least one hot start antibody, at least one hot start aptamer, and/or at least one hot start Affibody®. In some embodiments, a hot start composition comprises at least one polymerase described herein with or without a hot start chemical modification, at least one hot start antibody and at least one hot start aptamer or at least one hot start Affibody®. In some embodiments, a hot start composition comprises at least one polymerase described herein with or without a hot start chemical modification, at least one hot start Affibody® and at least one hot start antibody or at least one hot start aptamer. In some embodiments, a hot start composition comprises a polymerase described herein with or without a hot start chemical modification, a hot start antibody, and a hot start aptamer or a hot start Affibody®. In some embodiments, a hot start composition comprises a polymerase described herein with or without a hot start chemical modification, a hot start Affibody®, and a hot start antibody or a hot start aptamer. In some embodiments, a hot start composition comprises a polymerase described herein with or without a hot start chemical modification, a hot start antibody, and a hot start Affibody®. In some embodiments, a hot start composition comprises a polymerase described herein with or without a hot start chemical modification, a hot start antibody, and a hot start aptamer.

In some embodiments, a composition comprises one or more detergents, one or more protein stabilizers, and/or at least one UTPase. In some embodiments, a composition comprises one or more detergents, one or more protein stabilizers, and at least one UTPase. In some embodiments, a composition comprises at least one monovalent cationic salt, at least one divalent cationic salt, and/or at least one dNTP. In some embodiments, a composition further comprises at least one dye. In some embodiments, a composition comprises additional stabilizers that increase the density of the composition.

Nonlimiting exemplary detergents that may be used in the compositions provided herein include nonionic, ionic (anionic, cationic) and zwitterionic detergents. Exemplary such detergents include, but are not limited to, Hecameg (6-O—(N-Heptylcarbamoyl)-methyl-α-D-glucopyranoside), Trition X-200, Brij-58, CHAPS, n-Dodecyl-b-D-maltoside, NP-40, sodium dodecyl sulphate (SDS), TRITON® X-15, TRITON® X-35, TRITON® X-45, TRITON® X-100, TRITON® X-102, TRITON® X-114, TRITON® X-165, TRITON® X-305, TRITON® X-405, TRITON® X-705, Tween® 20 and/or ZWITTERGENT®. Other detergents may also be suitable, as may be determined by one of skill in the art. See, e.g., U.S. Pat. No. 7,972,828B2, U.S. Pat. No. 8,980,333B2 U.S. Publication No. 2008/0145910; U.S. Publication No. 2008/0064071; U.S. Pat. Nos. 6,242,235; 5,871,975; and 6,127,155 for exemplary detergents.

Nonlimiting exemplary protein stabilizers that may be used in the compositions provided herein include BSA, inactive polymerases (such as inactivated Taq polymerase; see, e.g., US Publication No. 2011/0059490), and apotransferrin. Further nonlimiting exemplary stabilizers that may be used in the compositions provided herein include glycerol, trehalose, lactose, maltose, galactose, glucose, sucrose, dimethyl sulfoxide (DMSO), polyethylene glycol, and sorbitol.

Nonlimiting exemplary UTPases that may be used in the compositions provided herein include UTPases from thermophilic bacteria. See, e.g., PNAS, 2002, 99: 596-601.

Nonlimiting exemplary dyes that may be used in the compositions provided herein include xylene cyanol FF, tartrazine, phenol red, quinoline yellow, zylene cyanol, Brilliant Blue, Patent Blue, indigocarmine, acid red 1, m-cresol purple, cresol red, neutral red, bromocresol green, acid violet 5, bromo phenol blue, and orange G (see, e.g., U.S. Pat. No. 8,663,925 B2). Additional nonlimiting exemplary dyes are described, e.g., in U.S. Pat. No. 6,942,964. One skilled in the art will appreciate that any dye that does not inhibit nucleic acid synthesis by the polymerases described herein may be used.

In some embodiments, a storage composition is provided comprising a polymerase provided herein, at least one hot start antibody, at least one protein stabilizer, and at least one UTPase, in a buffer suitable for storage. In some embodiments, a storage composition is provided comprising a polymerase provided herein, at least one hot start antibody, at least one Affibody®, at least one protein stabilizer, and at least one UTPase, in a buffer suitable for storage. In some embodiments, a storage composition is provided comprising a polymerase provided herein, two hot start antibodies, a protein stabilizer, and a UTPase, in a buffer suitable for storage. In some embodiments, the storage buffer comprises a buffering agent (such as Tris HCl), a salt (such as KCl or NaCl), a stabilizer (such as glycerol), a reducing agent (such as DTT), a divalent cation chelating agent (such as EDTA), and a detergent (such as hecameg and/or Triton X-200 and/or NP-40 and/or Tween-20, etc.). In some embodiments, the storage composition comprises 0.5 to 5 units (U), or 0.5 to 3 U, or 1 to 3 U, or 2 U of polymerase per μl. In some embodiments, the storage composition comprises 0.05 to 1 mg/ml, or 0.05 to 0.5 mg/ml, or 0.1 to 0.5 mg/ml, or 0.1 to 0.3 mg/ml of each hot start antibody. In some embodiments, the storage composition comprises 0.1 to 10 mg/ml, or 0.1 to 5 mg/ml, or 0.5 to 5 mg/ml, or 0.5 to 2 mg/ml of each hot start Affibody®. In some embodiments, the storage composition comprises 0.5 to 5 mg/ml, or 1 to 5 mg/ml, or 1 to 3 mg/ml of each protein stabilizer.

In some embodiments, a reaction composition is provided, comprising at least one polymerase described herein, at least one buffering agent (such as Tris HCl), at least one monovalent cationic salt (such as KCl or NaCl), at least one divalent cationic salt (such as $MgCl_2$ or $MnCl_2$), at least one detergent (such as hecameg and/or Triton X-200 and/or NP-40 and/or Tween-20, etc.), and at least one dNTP. In some embodiments, the composition comprises dATP, dCTP, dGTP, and dTTP. In some embodiments, the reaction composition further comprises at least one dye. In some embodiments, for example when the composition is to be loaded on a gel, the reaction composition comprises additional stabilizers that increase the density of the composition, such as polyethylene glycol (e.g., PEG 4000) and/or sucrose. PEG 4000 may be included, in some embodiments, at a concentration of 0.5-2%, or about 1%; and sucrose may be included, in some embodiments, at a concentration of 1-5%, or 1-3%, or about 2% (or 2-10%, or 2-6%, or about 4% for a 2× reaction composition). In some embodiments, the buffering agent (such as Tris HCl) is present at a concentration of 5-50 mM, or 5-30 mM, or 5-20 mM (or 10-100 mM, or 10-60 mM, or 10-40 mM for a 2× reaction composition). In some embodiments, the monovalent cation (such as K+ or Na+) is present at a concentration of 50-300 mM, or 50-200 mM, or 75-150 mM, or about 110 mM (or 100-600 mM, or 100-400 mM, or 150-300 mM, or about 220 mM for a 2× reaction composition). In some embodiments, a detergent (such as hecameg and/or Triton X-200 and/or NP-40 and/or Tween-20, etc.) is present at a concentration of 0.05-0.3%, or 0.1-0.2%, or about 0.15% (or 0.01-0.6%, or 0.2-0.4%, or about 0.3% for a 2× reaction composition). In some embodiments, the $Mg^{2+}$ or $Mn^{2+}$ is present at a concentration of 0.5-5 mM, or 0.5-3 mM, or about 1.5 mM (or 1-10 mM, or 1-6 mM, or about 3 mM for a 2× reaction composition). In some embodiments, each dNTP is present at a concentration of 0.05-1 mM, or 0.1-0.8 mM, or 0.1-0.6 mM, or 0.1-0.4 mM, or about 0.2 mM (or 0.1-2 mM, or 0.2-1.6 mM, or 0.2-1.2 mM, or 0.2-0.8 mM, or about 0.4 mM for a 2× reaction composition).

PCR enhancing factors may also be used to improve efficiency of the amplification. As used herein, a "PCR enhancing factor" or a "Polymerase Enhancing Factor" (PEF) refers to a complex or protein possessing polynucleotide polymerase enhancing activity (Hogrefe et al., 1997, Strategies 10:93-96; and U.S. Pat. No. 6,183,997, both of which are hereby incorporated by references). For Pfu DNA polymerase, for example, PEF may comprise either P45 in native form (as a complex of P50 and P45) or as a recombinant protein. In the native complex of Pfu P50 and P45, only P45 exhibits PCR enhancing activity. The P50 protein is similar in structure to a bacterial flavoprotein. The P45 protein is similar in structure to dCTP deaminase and dUTPase, but it functions only as a dUTPase converting dUTP to dUMP and pyrophosphate. PEF, according to the present disclosure, may also be selected from the group consisting of: an isolated or purified naturally occurring polymerase enhancing protein obtained from an archaeabacteria source (e.g., *Pyrococcus furiosus*); a wholly or partially synthetic protein having the same amino acid sequence as Pfu P45, or analogs thereof possessing polymerase enhancing activity; polymerase-enhancing mixtures of one or more of said naturally occurring or wholly or partially synthetic proteins; polymerase-enhancing protein complexes of one or more of said naturally occurring or wholly or partially synthetic proteins; or polymerase-enhancing partially purified cell extracts containing one or more of said naturally occurring proteins (U.S. Pat. No. 6,183,997, supra).

In some embodiments, a reaction composition further comprises ingredients that enhance nucleic acid synthesis from high GC-content templates. In some such embodiments, the reaction composition comprises glycerol, DMSO, and/or ammonium sulphate. In some embodiments, the reaction composition comprises glycerol, DMSO, and ammonium sulphate. In some embodiments, glycerol is present in the reaction composition at a concentration of 5-20%, or 5-15%, or about 10%. In some embodiments, DMSO is present in the reaction composition at a concentration of 1-10%, or 3-10%, or 3-7%, or about 5%. In some embodiments, ammonium sulphate is present in the reaction composition at 10-50 mM, or 15-40 mM, or 20-30 mM, or about 25 mM.

In some embodiments, a reaction composition is provided at 2×, 5×, 10×, etc. concentration, in which case, the concentrations discussed herein are multiplied (e.g., as noted above; doubled for 2×). A 2× reaction composition is typically diluted by 2-fold, for example, when the template nucleic acid and/or primers are added to the composition.

In some embodiments, a reaction composition comprises nucleic acid template and at least one primer for nucleic acid synthesis. In some embodiments, each primer is included in the reaction composition at a concentration of 0.1-0.8 µM, or 0.1-0.5 µM, or 0.2-0.4 µM, or about 0.3 µM. One skilled in the art will appreciate that the template nucleic acid may be provided at a wide range of concentrations, which lower limit, in some embodiments, may be determined by the sensitivity of the polymerase.

In some embodiments, the composition comprises at least one PCR inhibitor. In some embodiments, the PCR inhibitor comprises xylan, heparin, humic acid, or SDS. In some embodiments, methods according to the disclosure comprise amplifying DNA in the presence of at least one PCR inhibitor. In some embodiments, the PCR inhibitor comprises xylan. In some embodiments, the PCR inhibitor comprises heparin.

In various embodiments, the composition may be an aqueous composition. In various embodiments, the composition may be a lyophilized composition. In some embodiments, the composition comprises a cryoprotectant and/or a preservative and/or other additives known to those skilled in the art. Nonlimiting exemplary cryoprotectants and preservatives include, for example, the stabilizers and reducing agents described herein.

Nucleic Acids; Vectors; Host Cells; Methods of Production and/or Purification.

Provided herein are nucleic acids comprising a sequence encoding a polymerase according to this disclosure. In some embodiments, the nucleic acid is operably linked to a promoter. In some embodiments, the promoter is a promoter for a bacteriophage RNA polymerase, such as a T7 promoter. In some embodiments, the nucleic acid is codon-optimized for expression in a host cell, such as a microorganism, e.g., a bacterium, such as *E. coli*.

Also provided herein are vectors comprising any of the nucleic acids comprising a sequence encoding a polymerase according to this disclosure discussed above. In some embodiments, the vector is a plasmid. In some embodiments, the vector is an expression vector. In some embodiments, the vector contains a selectable marker. In some embodiments, the vector is capable of being propagated in a microorganism, e.g., a bacterium, such as *E. coli*.

Also provided herein are host cells comprising any of the nucleic acids comprising a sequence encoding a polymerase according to this disclosure discussed above. Also provided herein are host cells comprising any of the vectors comprising a sequence encoding a polymerase according to this disclosure discussed above. In some embodiments, the host cell is a microorganism, e.g., a bacterium, such as *E. coli*. In some embodiments, the host cell further comprises a nucleic acid encoding a heterologous RNA polymerase. In some embodiments, the heterologous RNA polymerase is a bacteriophage RNA polymerase, such as bacteriophage T7 RNA polymerase. In some embodiments, the heterologous RNA polymerase is operably linked to a promoter, such as an inducible promoter, e.g., a lac-inducible promoter. In some embodiments, the host cell is of a protease-deficient strain. In some embodiments, the host cell is *E. coli* BL-21. In some embodiments, the host cell, such as BL-21, is modified to carry tRNA genes encoding tRNAs with rarer anticodons (for example, argU, ileY, leuW, and proL tRNA genes).

Also provided herein are methods of producing and/or purifying a polymerase according to this disclosure. In some embodiments, such a method comprises culturing at least one host cell comprising a nucleic acid encoding a thermophilic DNA polymerase according to this disclosure, wherein the at least one host cell expresses the thermophilic DNA polymerase. In some embodiments, such a method comprises isolating a polymerase according to this disclosure from host cells that have expressed the polymerase. In some embodiments, the isolating comprises lysing the host cells. In some embodiments, the isolating comprises heat treatment to denature host proteins. In some embodiments, denatured host proteins are removed, e.g., by centrifugation. In some embodiments, the polymerase is purified via chromatography. Examples of procedures for purifying DNA polymerases are provided, e.g., in Lawyer et al. (1993, *PCR Meth. & App.* 2: 275) (designed originally for the isolation of Taq polymerase) and Kong et al. (1993, *J. Biol. Chem.* 268: 1965) (involving a heat denaturation step of host proteins, and two column purification steps over DEAE-Sepharose and heparin-Sepharose columns).

EXAMPLES

The following examples are provided to illustrate certain disclosed embodiments and are not to be construed as limiting the scope of this disclosure in any way.

Example 1. Tolerance of Inhibitors by a Thermophilic DNA Polymerase According to the Disclosure The inhibitor resistance of a thermophilic DNA polymerase with the sequence of SEQ ID NO: 20 (including a Q at position 762) (762Q polymerase) was compared to a version with a K at position 762 (762K polymerase) by amplifying PCR fragments in the presence of various amounts of polymerase inhibitors. The performance of a thermophilic DNA polymerase with the sequence of SEQ ID NO: 22 (including a Q at position 762 and S at position 408) (408S 762Q polymerase) was compared to a version with a K at position 762 (408S 762K polymerase) by amplifying PCR fragments in the presence of various amounts of polymerase inhibitors.

Heparin. A 2 kb fragment was amplified from 20 ng of human genomic DNA template in 20 µl PCR reactions in the presence of 0 to 0.3 µM of heparin using the thermophilic DNA polymerases (FIG. 1). Primers with the following sequences were used: GAAGAGCCAAGGACAGGTAC (SEQ ID NO: 64) (forward); CCTCCAAATCAAGCCTCTAC (SEQ ID NO: 65) (reverse). The PCR program was as follows:

| 98° C. | 30 s |     |
|--------|------|-----|
| 98° C. | 10 s | x30 |
| 60° C. | 10 s |     |
| 72° C. | 1 min |    |
| 72° C. | 5 min |    |

Products were detected by agarose gel electrophoresis and staining with Ethidium bromide. Detectable product was observed at up to 0.25 µM heparin for the 762Q polymerase and 0.15 µM for 408S 762Q polymerase. Products were not detected at or above 0.1 µM heparin for the 762K and 408S 762K polymerases.

Figure 2:
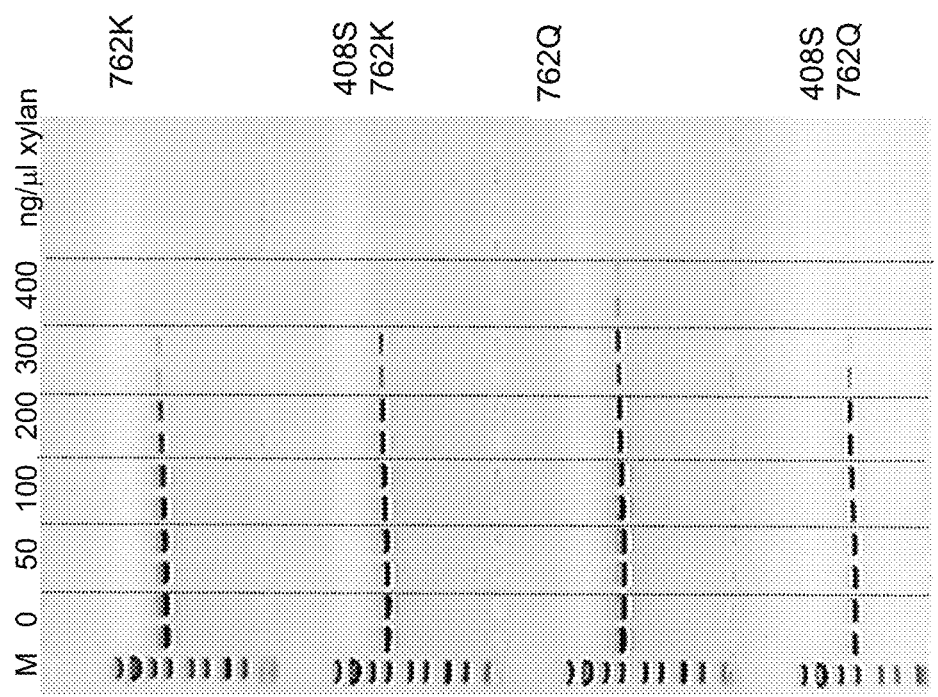
FIG. 2 shows a comparison of PCR amplifications in which xylan was present at a series of concentrations from 0 to 400 ng/µl and in which the polymerase comprised a family B thermophilic DNA polymerase catalytic domain with ("762Q") or without ("762K") a neutral amino acid residue at the position that aligns to position 762 of Pfu (SEQ ID NO: 1; aligning to position 379 of the Pfu catalytic domain (SEQ ID NO: 6)) and with ("408S") or without (no 408 designation) a serine at the position that aligns to position 762 of Pfu (SEQ ID NO: 1; aligning to position 25 of the Pfu catalytic domain (SEQ ID NO: 6)).

Xylan. A 2 kb fragment was amplified from 40 ng of human genomic DNA template in 20 µl PCR reactions in the presence of 0 to 400 ng/µl xylan using the thermophilic DNA polymerases (FIG. 2). The primers, PCR program, and product detection were as described above with respect to heparin.

Detectable product was observed at up to 400 ng/µl xylan for the 762Q polymerase. Products were not detected at 400 ng/µl xylan for the 762K polymerases.

Figure 3:
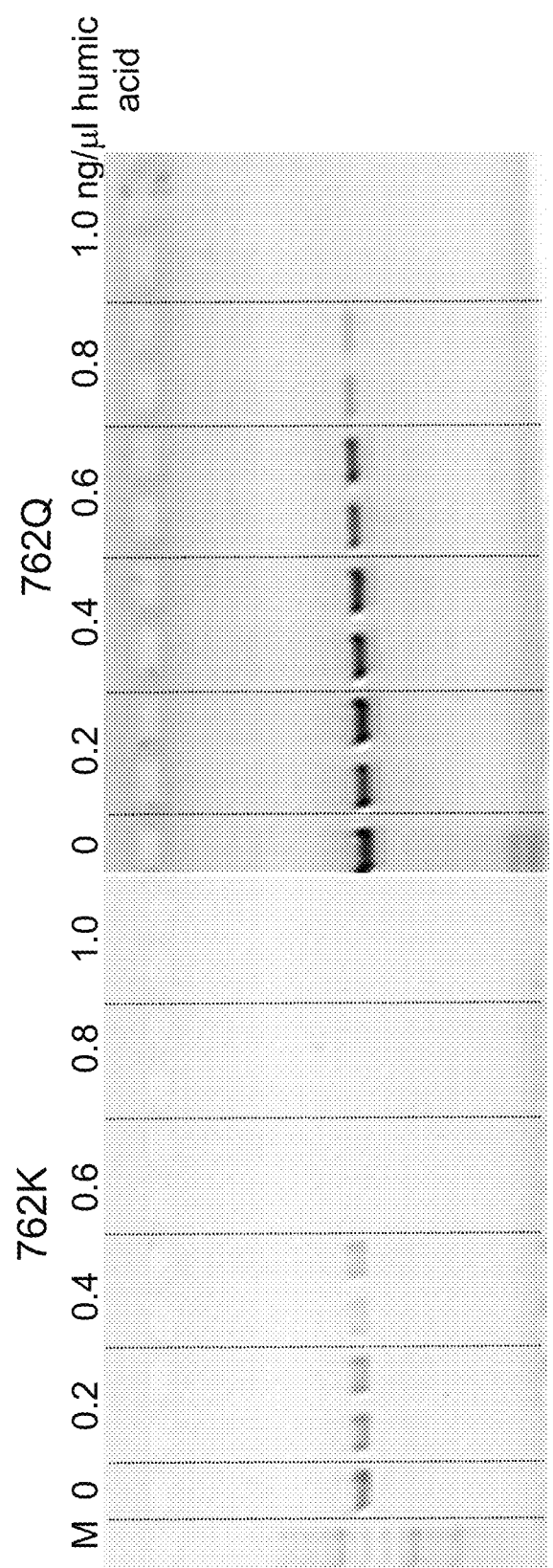
FIG. 3 shows a comparison of PCR amplifications in which humic acid was present at a series of concentrations from 0 to 1 ng/µl and in which the polymerase comprised a family B thermophilic DNA polymerase catalytic domain with ("762Q") or without ("762K") a neutral amino acid residue at the position that aligns to position 762 of Pfu (SEQ ID NO: 1; aligning to position 379 of the Pfu catalytic domain (SEQ ID NO: 6)).

Humic acid. A 2 kb fragment was amplified from 40 ng of human genomic DNA template in 20 µl PCR mixture in the presence of 0 to 1.0 ng/ml of humic acid using a thermophilic DNA polymerase with the sequence of SEQ ID NO: 20 (including a Q at position 762) was compared to a version with a K at position 762 (FIG. 3). Primers, the PCR program, and product detection were as described above with respect to heparin.

Figure 4:
FIG. 4 shows a comparison of PCR amplifications in which sodium dodecyl sulfate ("SDS") was present at a series of concentrations from 0 to 0.016% or 0.2% (w/v) and in which the polymerase comprised a family B thermophilic DNA polymerase catalytic domain with ("762Q") or without ("762K") a neutral amino acid residue at the position that aligns to position 762 of Pfu (SEQ ID NO: 1; aligning to position 379 of the Pfu catalytic domain (SEQ ID NO: 6)).

Sodium dodecyl sulfate. A 2 kb fragment was amplified from 40 ng of human genomic DNA template in 20 µl PCR mixture in the presence of 0 to 0.016% or 0.2% (w/v) sodium dodecyl sulfate (SDS) using the 762Q or 762K polymerases (FIG. 4). The primers, PCR program, and product detection were as described above with respect to heparin.

Thus, increased inhibitor tolerance was observed for the polymerases with a Q at position 762.

Example 2. Yield and Sensitivity of PCR with a Thermophilic DNA Polymerase According to the Disclosure The PCR performance (sensitivity and yield) of the 762Q and 762K polymerases discussed in Example 1 were compared by amplifying PCR fragments from various amounts of DNA template.

Figure 5:
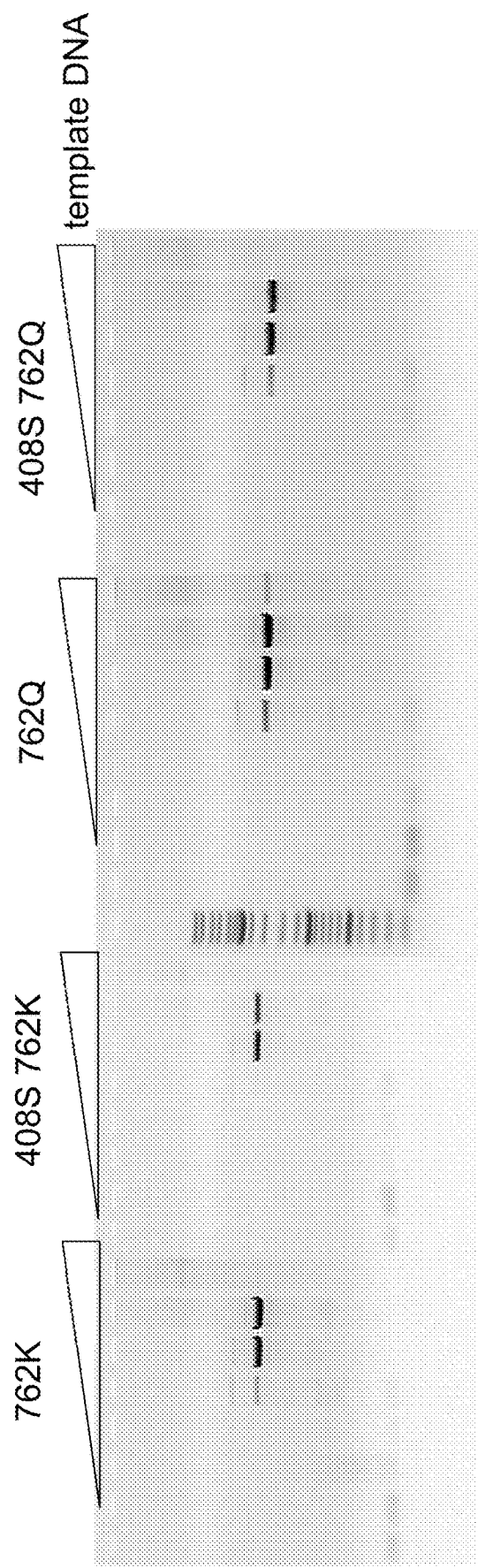
FIG. 5 shows a comparison of PCR amplifications in which a 2 kb fragment was amplified from a series of amounts of human genomic DNA template between 0 and 400 ng in a 20 µl PCR mixture using a polymerase comprising a family B thermophilic DNA polymerase catalytic domain with ("762Q") or without ("762K") a neutral amino acid residue at the position that aligns to position 762 of Pfu (SEQ ID NO: 1; aligning to position 379 of the Pfu catalytic domain (SEQ ID NO: 6)) and with ("408S") or without (no 408 designation) a serine at the position that aligns to position 762 of Pfu (SEQ ID NO: 1; aligning to position 25 of the Pfu catalytic domain (SEQ ID NO: 6)).

Sensitivity. A 2 kb fragment was amplified from a series of amounts of human genomic DNA template between 0 and 400 ng in a 20 µl PCR mixture using the thermophilic DNA polymerases (FIG. 5). The primers and the PCR program were the same as those used in Example 1. Products were analyzed by agarose gel electrophoresis and stained as in Example 1.

The results showed that the reaction with the 762Q polymerase had higher sensitivity (amplification from lower amounts of template DNA) than with the 762K polymerase, and the reaction with the 408S 762Q polymerase had higher sensitivity than with the 408S 762K polymerase.

Yield A 10 kb fragment was amplified from a series of amounts of phage lambda DNA template between 0 and 200 ng in a 20 µl PCR mixture using the thermophilic DNA polymerases. The primers were: CAGTGCAGTGCTTGATAACAGG (SEQ ID NO: 66) (forward) and GTAGTGCGCGTTTGATTTCC (SEQ ID NO: 67) (reverse). The PCR program was:

| 98° C. | 30 s  |     |
|--------|-------|-----|
| 98° C. | 10 s  |     |
| 60° C. | 15 s  | x25 |
| 72° C. | 150 s |     |
| 72° C. | 10 min |   |

Figure 6A:
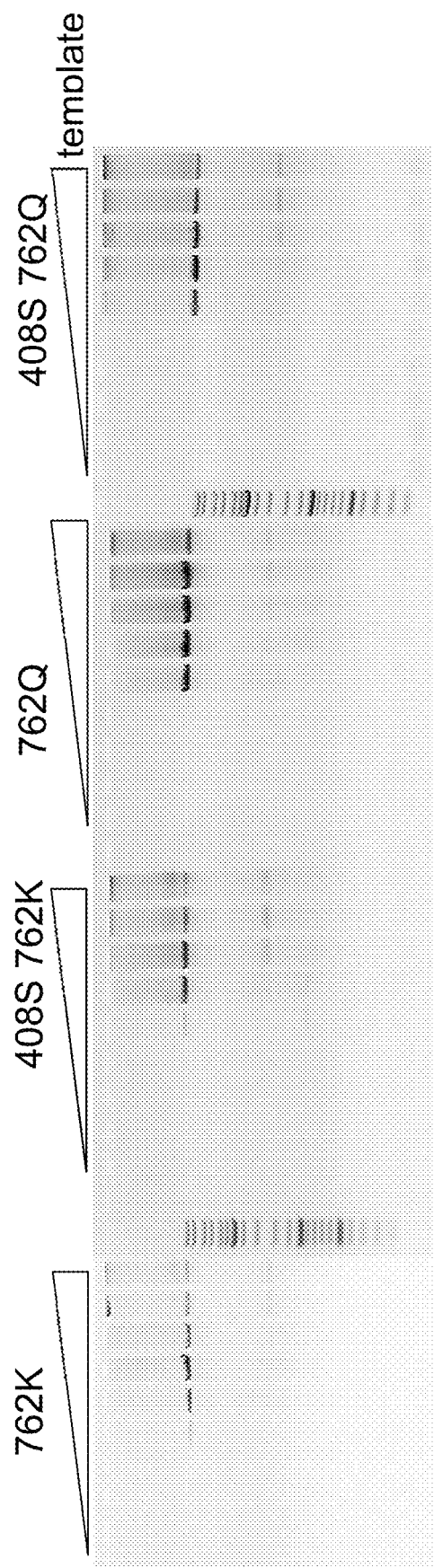
FIG. 6A shows a comparison of PCR amplifications in which a 10 kb fragment was amplified from a series of amounts of bacteriophage lambda DNA template between 0 and 200 ng in a 20 µl PCR mixture using a polymerase comprising a family B thermophilic DNA polymerase catalytic domain with ("762Q") or without ("762K") a neutral amino acid residue at the position that aligns to position 762 of Pfu (SEQ ID NO: 1; aligning to position 379 of the Pfu catalytic domain (SEQ ID NO: 6)) and with ("408S") or without (no 408 designation) a serine at the position that aligns to position 762 of Pfu (SEQ ID NO: 1; aligning to position 25 of the Pfu catalytic domain (SEQ ID NO: 6)).
Figure 6B:
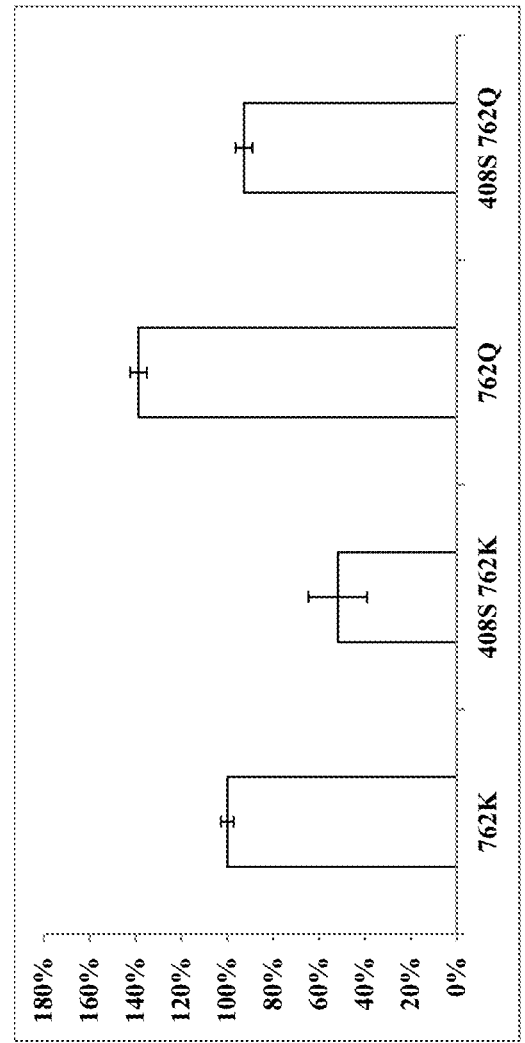
FIG. 6B shows a bar graph illustrating yield from amplification of a 10 kb fragment from a series of amounts of bacteriophage lambda DNA template using a polymerase comprising a family B thermophilic DNA polymerase catalytic domain with ("762Q") or without ("762K") a neutral amino acid residue at the position that aligns to position 762 of Pfu (SEQ ID NO: 1; aligning to position 379 of the Pfu catalytic domain (SEQ ID NO: 6)) and with ("408S") or without (no 408 designation) a serine at the position that aligns to position 762 of Pfu (SEQ ID NO: 1; aligning to position 25 of the Pfu catalytic domain (SEQ ID NO: 6)).

Products were analyzed by agarose gel electrophoresis and stained as in Example 1. The results from two experiments showed that the reaction sensitivity (amplification from lower amounts of template DNA) was similar for all the polymerases (FIG. 6A), while the 762Q polymerase showed the highest yield (140% from the 762K polymerase) amplifying the 10 kb fragment from 0.5 ng of the template (FIG. 6B).

Example 3. Fidelity of Thermophilic DNA Polymerases According to the Disclosure Polymerase fidelity was measured by next generation sequencing. Fragmented *E. coli* DNA (~300 bp) was amplified by Taq polymerase, 762K polymerase, 762Q polymerase, 408S 762K polymerase and 408S 762Q polymerase. The number of effective PCR cycles was found by qPCR. The amplified libraries were subjected to paired-end Illumina sequencing together with control *E. coli* PCR-free libraries. The polymerase error rates were calculated using bioinformatics techniques. The background level of experimental errors was estimated from PCR-free library sequencing data. The polymerase introduced errors were identified as nucleotide changes in both pair-end reads, while nucleotide changes in only pair-end one read have been treated as instrumental errors and were eliminated. The polymerase fidelities (1/error rate) were normalized to the fidelity of Taq polymerase, which fidelity value is indicated as 1×.

The fidelity of the 762K polymerase was ~50× of the Taq polymerase, the 762Q polymerase also showed similar fidelity (Table 1). The error rates for the 408S 762K and A408S 762Q polymerases were almost indistinguishable from the background, which indicate >100× fidelity of the Taq polymerase and is the threshold of fidelity measurements using this particular experimental setup. A thermophilic DNA polymerase with the sequence of SEQ ID NO: 95 (including a H at position 36, S at a position 408 and Q at position 762; "36H 408S 762Q polymerase") was also found to have a fidelity of >100× of the Taq polymerase.

TABLE 1

| Polymerase | Fidelity, xTaq polymerase fidelity |
|---|---|
| Taq | 1 x |
| 762K | 20-70 x |
| 762Q | 20-70 x |
| 408S 762K | >100 x * |
| 408S 762Q | >100 x * |

* 100 x Taq fidelity is the threshold of fidelity measurements

Example 4. Yield and Sensitivity of PCR with a Thermophilic DNA Polymerase According to the Disclosure Provided as Hot-Start Compositions The performance of a thermophilic DNA polymerase with the sequence of SEQ ID NO: 22 (including a Q at position 762 and S at position 408) (408S 762Q polymerase) was compared to a version with a K at position 762 (408 S 762K polymerase) by amplifying various PCR fragments, with the polymerases being provided as dual hot-start compositions. A dUTPase was also supplied in the reactions.

2 kb fragment from human genomic DNA template. The template was human genomic DNA in a series of amounts between 0 and 400 ng in 20 μl reactions. The primers and the PCR program were the same as in Example 1.

Figure 7A:
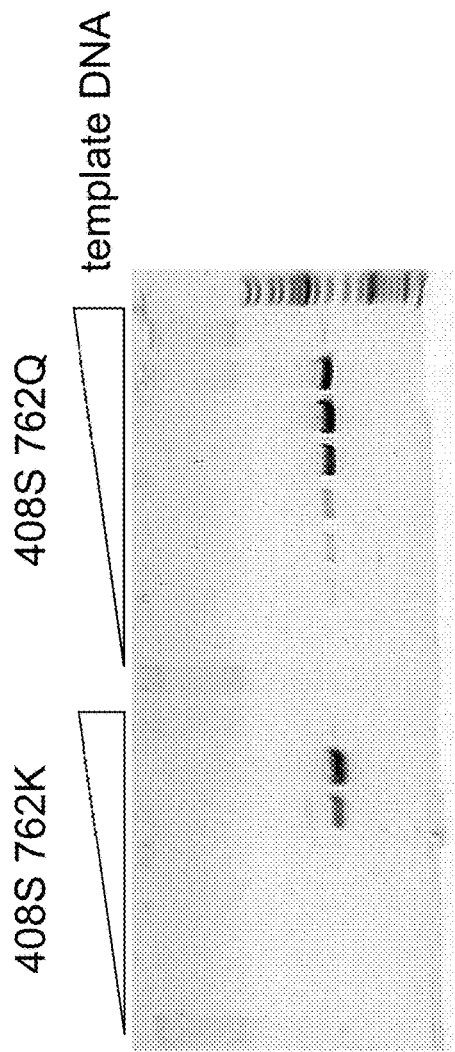
FIG. 7A shows a comparison of PCR amplifications of a 2 kb product in which human genomic DNA template was present at a series of amounts from 0 to 400 ng in a reaction volume of 20 µl and in which the polymerase comprised a family B thermophilic DNA polymerase catalytic domain without ("408S 762K") or with ("408S 762Q") a neutral amino acid residue at the position that aligns to position 762 of Pfu (SEQ ID NO: 1; aligning to position 379 of the Pfu catalytic domain (SEQ ID NO: 6)) and with a serine at the position that aligns to position 762 of Pfu (SEQ ID NO: 1; aligning to position 25 of the Pfu catalytic domain (SEQ ID NO: 6)).

The 408S 762Q polymerase showed increased yield and higher sensitivity relative to the 408S (FIG. 7A).

5 kb fragment from phage lambda DNA template. PCR primers were CCTGCTCTGCCGCTTCACGC (SEQ ID NO: 68) (forward) and CGAACGTCGCGCAGAGAAACAGG (SEQ ID NO: 69) (reverse). The PCR program was:

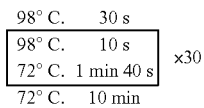

Figure 7B:
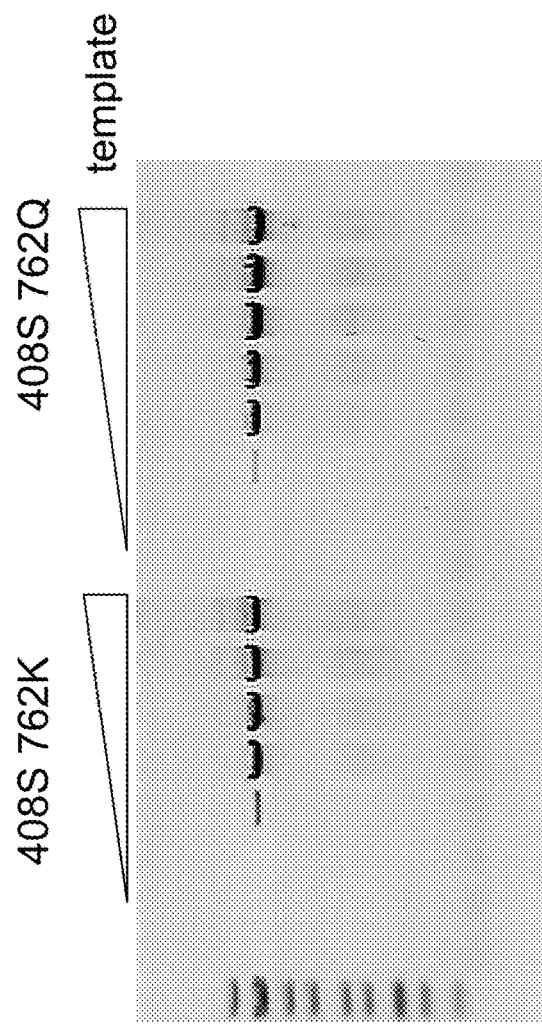
FIG. 7B shows a comparison of PCR amplifications of a 5 kb product in which bacteriophage lambda DNA template was present at a series of amounts from 0 to 200 ng in a reaction volume of 20 µl and in which the polymerase comprised a family B thermophilic DNA polymerase catalytic domain without ("408S 762K") or with ("408S 762Q") a neutral amino acid residue at the position that aligns to position 762 of Pfu (SEQ ID NO: 1; aligning to position 379 of the Pfu catalytic domain (SEQ ID NO: 6)) and with a serine at the position that aligns to position 762 of Pfu (SEQ ID NO: 1; aligning to position 25 of the Pfu catalytic domain (SEQ ID NO: 6)).

Lambda DNA was provided as template at amounts between 0 and 200 ng in 20 μl reactions. Products were analyzed by agarose gel electrophoresis and stained as in Example 1. Sensitivity was higher for reactions with the 408S 762Q polymerase (FIG. 7B).

20 kb fragment from phage lambda DNA template. PCR primers were CTGATGAGTTCGTGTCCGTA-CAACTGGCGTAATC (SEQ ID NO: 70) (forward) and GTGCACCATGCAACATGAATAACAGTGGGTTATC (SEQ ID NO: 71) (reverse). The PCR program was:

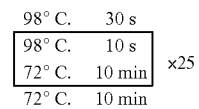

Figure 8:
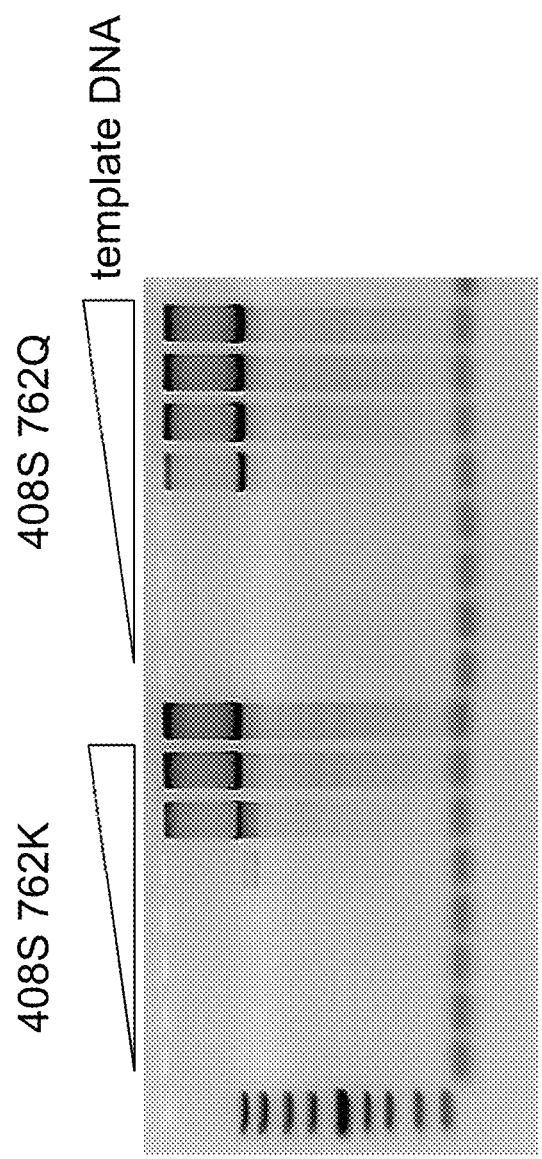
FIG. 8 shows a comparison of PCR amplifications of a 20 kb product in which bacteriophage lambda DNA template was present at a series of amounts from 0 to 100 ng in a reaction volume of 20 µl and in which the polymerase comprised a family B thermophilic DNA polymerase catalytic domain without ("408S 762K") or with ("408S 762Q") a neutral amino acid residue at the position that aligns to position 762 of Pfu (SEQ ID NO: 1; aligning to position 379 of the Pfu catalytic domain (SEQ ID NO: 6)) and with a serine at the position that aligns to position 762 of Pfu (SEQ ID NO: 1; aligning to position 25 of the Pfu catalytic domain (SEQ ID NO: 6)).

Lambda DNA was provided as template at amounts between 0 and 100 ng in 20 μl reactions. Products were analyzed by agarose gel electrophoresis and stained as in Example 1. Band intensities from lower amounts of the template were generally greater for reactions with the 408S 762Q polymerase, indicating increased yield and sensitivity (FIG. 8).

20 kb fragment from *Escherichia coli* genomic DNA template. PCR primers were: GGGCGTTTTCCGTAACACTG (SEQ ID NO: 72) (forward) and TGACCACATACAATCGCCGT (SEQ ID NO: 73) (reverse). The PCR program was:

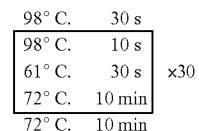

*E. coli* gDNA template was provided as template at amounts between 0 and 40 ng in 20 μl reactions. Products were analyzed by agarose gel electrophoresis and stained as in Example 1.

Figure 9:
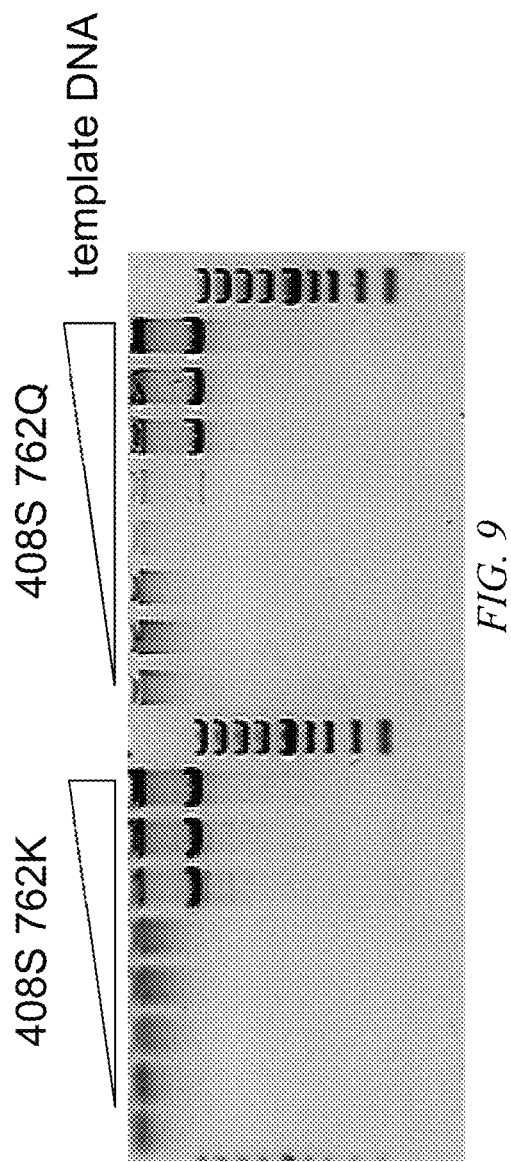
FIG. 9 shows a comparison of PCR amplifications of a 20 kb product in which *Escherichia coli* genomic DNA template was present at a series of amounts from 0 to 40 ng in a reaction volume of 20 µl and in which the polymerase comprised a family B thermophilic DNA polymerase catalytic domain without ("408S 762K") or with ("408S 762Q") a neutral amino acid residue at the position that aligns to position 762 of Pfu (SEQ ID NO: 1; aligning to position 379 of the Pfu catalytic domain (SEQ ID NO: 6)) and with a serine at the position that aligns to position 762 of Pfu (SEQ ID NO: 1; aligning to position 25 of the Pfu catalytic domain (SEQ ID NO: 6)).

Band intensities from lower amounts of the template were generally greater for reactions with the 408S 762Q polymerase, indicating increased yield and sensitivity (FIG. 9).

7.5 kb fragment from human genomic DNA template. The template was human genomic DNA in a series of amounts between 0 and 400 ng in 20 μl reactions. Primers were: CTCCACAGGGTGAGGTCTAAGTGATGACA (SEQ ID NO: 74) (forward) and CAATCTCAGGGCAAGTTAAGG-GAATAGTG (SEQ ID NO: 75) (reverse). The PCR program was:

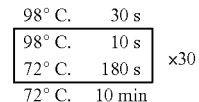

Figure 10:
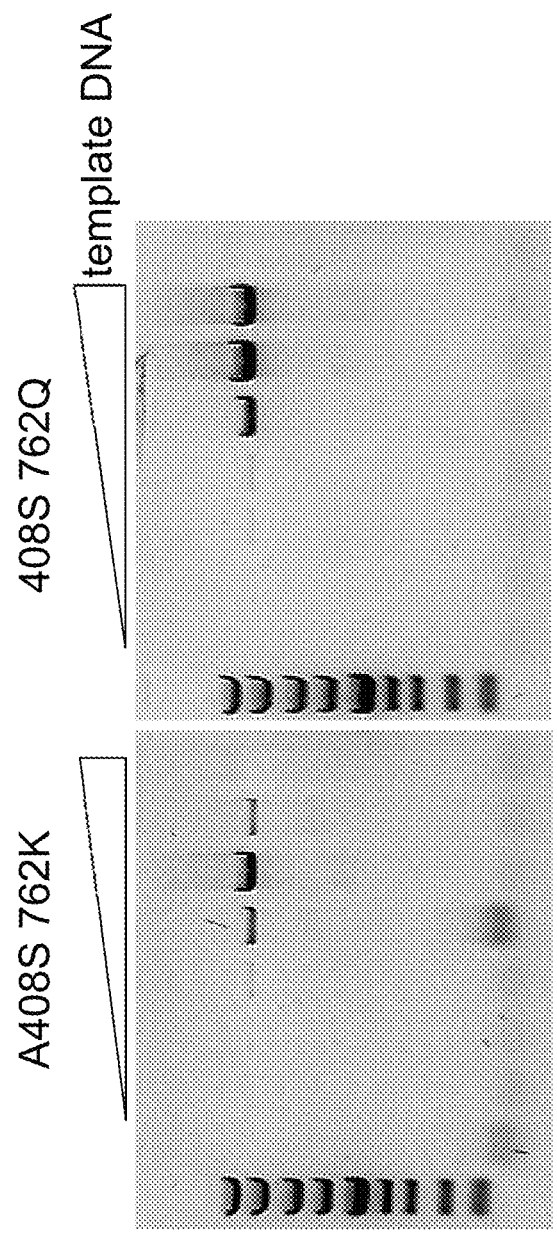
FIG. 10 shows a comparison of PCR amplifications of a 7.5 kb product in which human genomic DNA template was present at a series of amounts from 0 to 400 ng in a reaction volume of 20 µl and in which the polymerase comprised a family B thermophilic DNA polymerase catalytic domain without ("408S 762K") or with ("408S 762Q") a neutral amino acid residue at the position that aligns to position 762 of Pfu (SEQ ID NO: 1; aligning to position 379 of the Pfu catalytic domain (SEQ ID NO: 6)) and with a serine at the position that aligns to position 762 of Pfu (SEQ ID NO: 1; aligning to position 25 of the Pfu catalytic domain (SEQ ID NO: 6)).

Band intensities were greater for reactions with the 408S 762Q polymerase, indicating increased yield and sensitivity (FIG. 10).

Example 5. Fidelity of Thermophilic DNA Polymerases Provided as Hot-Start Compositions Polymerase fidelity was measured by next generation sequencing. Fragmented *E. coli* DNA (~300 bp) was amplified by Taq polymerase, 408S polymerase, and 408S 762Q polymerase with the polymerases being provided as dual hot-start compositions, including affibodies and antibodies. A dUTPase was also supplied in the reactions. Polymerase fidelities were measured as in the Example 3.

The error rates for the 408S and 408S 762Q polymerases were almost indistinguishable from the background, which indicate >100× fidelity of the Taq polymerase and is the threshold of fidelity measurements using this particular experimental setup (Table 2).

TABLE 2

| Polymerase | Fidelity, xTaq polymerase fidelity |
|---|---|
| Taq | 1 x |
| 408S | >100 x * |
| 408S 762Q | >100 x * |

\* 100 x Taq fidelity is the threshold of fidelity measurements

Figure 13:
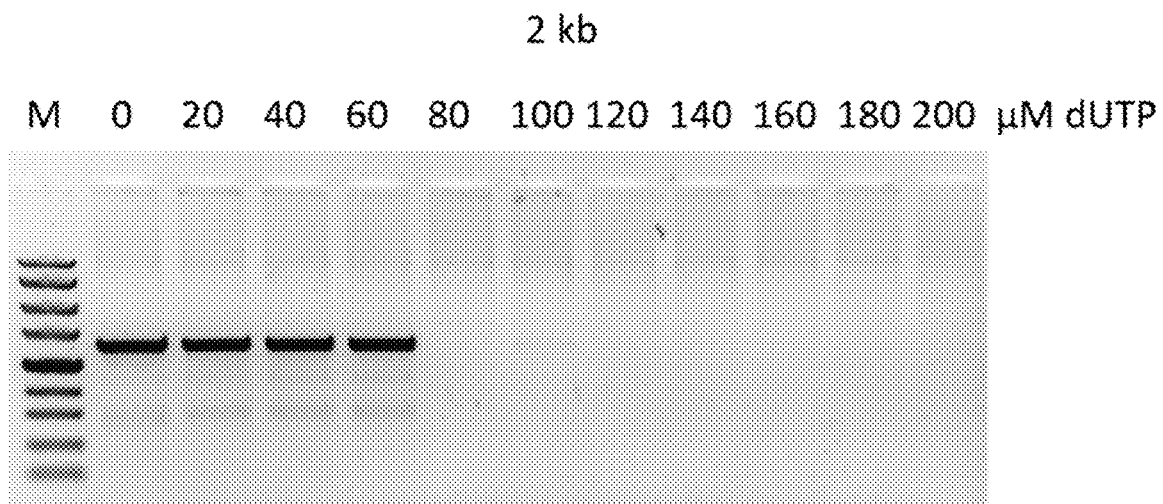
FIG. 13 shows amplification of a 2 kb human genomic DNA product by a 36H 408S 762Q polymerase in the presence increasing replacement of dTTP with dUTP.

Example 6. Tolerance of dUTP by a Thermophilic DNA Polymerase According to the Disclosure Tolerance of dUTP as a replacement for dTTP of a thermophilic DNA polymerase with the sequence of SEQ ID NO: 95 (including a H at position 36, S at a position 408 and Q at position 762; "36H 408S 762Q polymerase") was performed amplifying a 2 kb fragment of human genomic DNA.

dUTP replacement of dTTP (2 mM MgCl2). 2 kb fragment of human genomic DNA was amplified from 200 ng of human genomic DNA template in 50 μl PCR reactions in the presence of dATP, dCTP, and dGTP (each 200 μM) and variable amounts of dUTP replacing dTTP (the final concentration of dUTP and dTTP was 200 μM) (FIG. 13). Primers with the following sequences were used:

```
(forward)
                                        (SEQ ID NO: 64)
GAAGAGCCAAGGACAGGTAC (reverse)
                                        (SEQ ID NO: 65)
CCTCCAAATCAAGCCTCTAC
```

The PCR program was as follows:

| 98° C. | 30 s | |
|---|---|---|
| 98° C. | 10 s | |
| 61° C. | 30 s | x30 |
| 72° C. | 1 min | |
| 72° C. | 10 min | |

Figure 14:
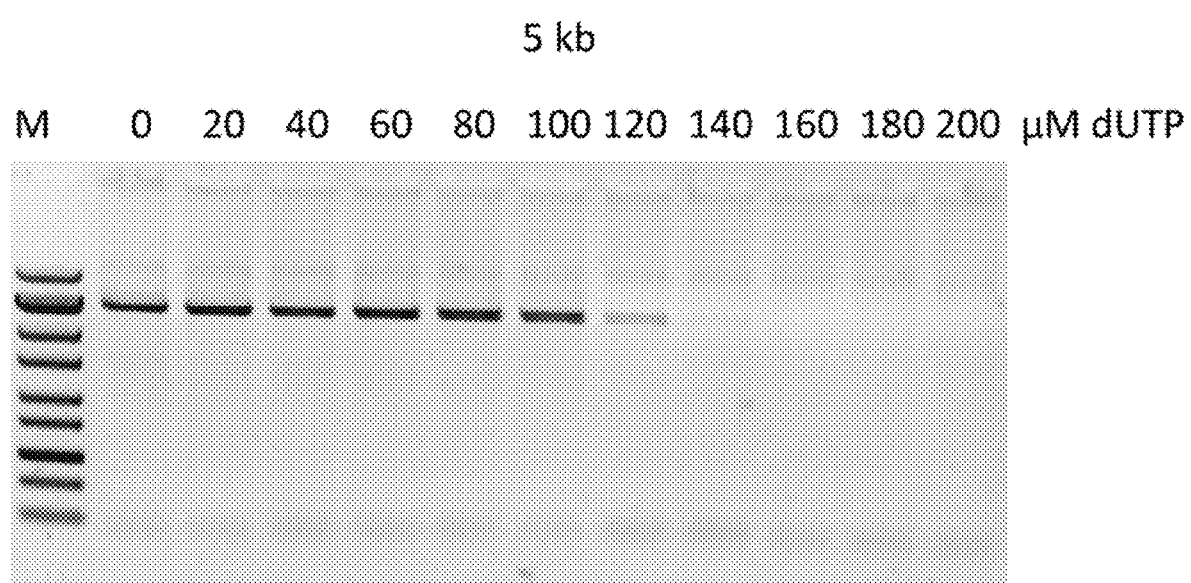
FIG. 14 shows amplification of a 5 kb human genomic DNA product by a 36H 408S 762Q polymerase in the presence increasing replacement of dTTP with dUTP.

Products were detected by agarose gel electrophoresis and staining with ethidium bromide. Detectable product was observed at up to when 60 μM dTTP was replaced with dUTP (FIG. 13).

dUTP replacement of dTTP (1.5 mM MgCl$_2$). 5 kb fragment of human genomic DNA was amplified from 200 ng of human genomic DNA template in 50 μl PCR reactions in the presence of dATP; dCTP, and dGTP (each 200 μM) and variable amounts of dUTP replacing dTTP (the final concentration of dUTP and dTTP was 200 μM) (FIG. 14). Primers with the following sequences were used:

```
(forward)
                                       (SEQ ID NO: 170)
CCAACATGGCGAAATGCTGT (reverse)
                                       (SEQ ID NO: 171)
CATCAACAACACGGTCAGCC
```

The PCR program was as follows:

| 98° C. | 30 s | |
|---|---|---|
| 98° C. | 10 s | |
| 61° C. | 30 s | x30 |
| 72° C. | 3 min | |
| 72° C. | 10 min | |

Products were detected by agarose gel electrophoresis and staining with ethidium bromide. Detectable product was observed at up to when 140 μM dTTP was replaced with dUTP (FIG. 14).

Figure 15:
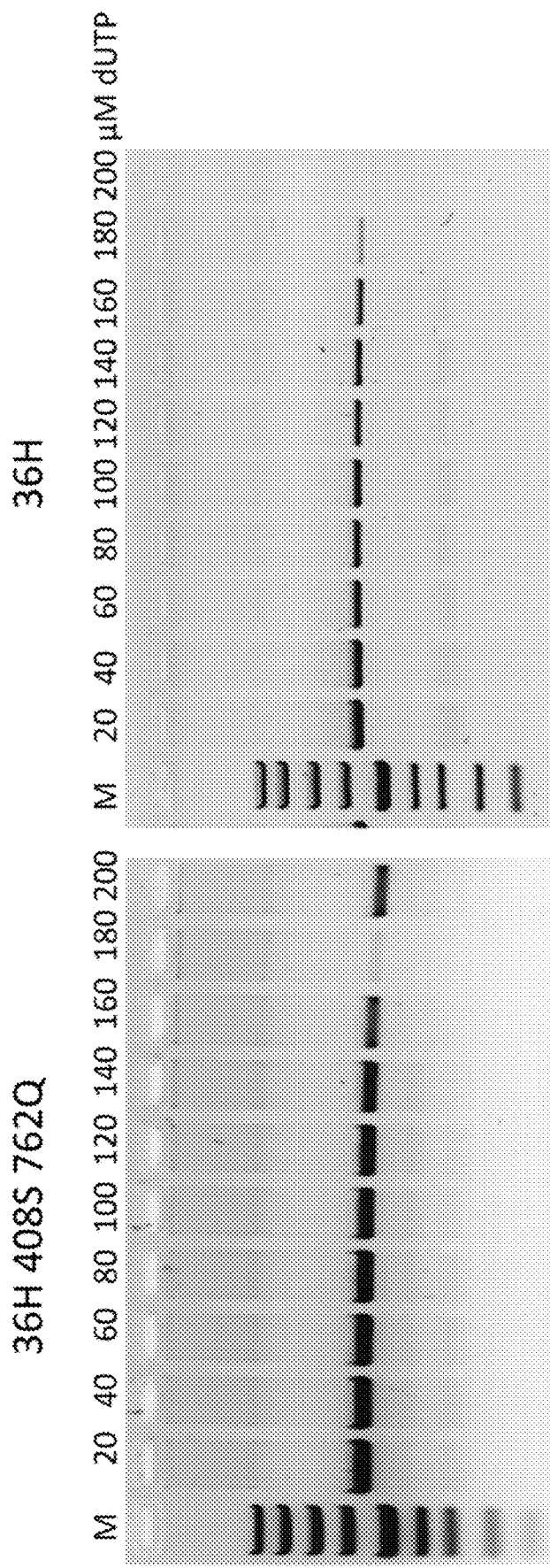
FIG. 15 shows amplification of a 2 kb human genomic DNA product by a 36H 408S 762Q polymerase and 36H polymerase in the presence of added dUTP

Additional dUTP. The PCR performance of the 36H 408S 762Q DNA polymerase and thermophilic DNA polymerase with the sequence of SEQ ID NO: 169 (including a H at position 36; "36H polymerase") were compared by amplifying 2 kb PCR fragments from 200 ng of human genomic DNA template in 50 μl PCR reactions in the presence of four standard dNTPs (each 200 μM) and increasing amounts of dUTP (from 0 μM to 200 μM) (FIG. 15; the 180 μM dUTP lane for the 36H 408S 762Q DNA polymerase appeared to have technical issues). The primers, PCR program, and product detection were as described above for the 2 kb human genomic fragment amplification in which dUTP replaced varying amounts of dTTP.

Easily detectable amounts of PCR product was observed even in the presence of 200 μM dUTP for the 36H 408S 762Q DNA polymerase. It is believed that the 36H 408S 762Q DNA polymerase would still produce detectable amounts of PCR product in the presence of dUTP concentrations of 220-260 μM. PCR products were not detected at 200 μM dUTP for 36H DNA polymerase.

The results showed that 36H 408S 762Q DNA polymerase can use dUTP as a replacement of dTTP in dNTPs mixture and has higher additional dUTP tolerance compared to 36H DNA polymerase.

Figure 16:
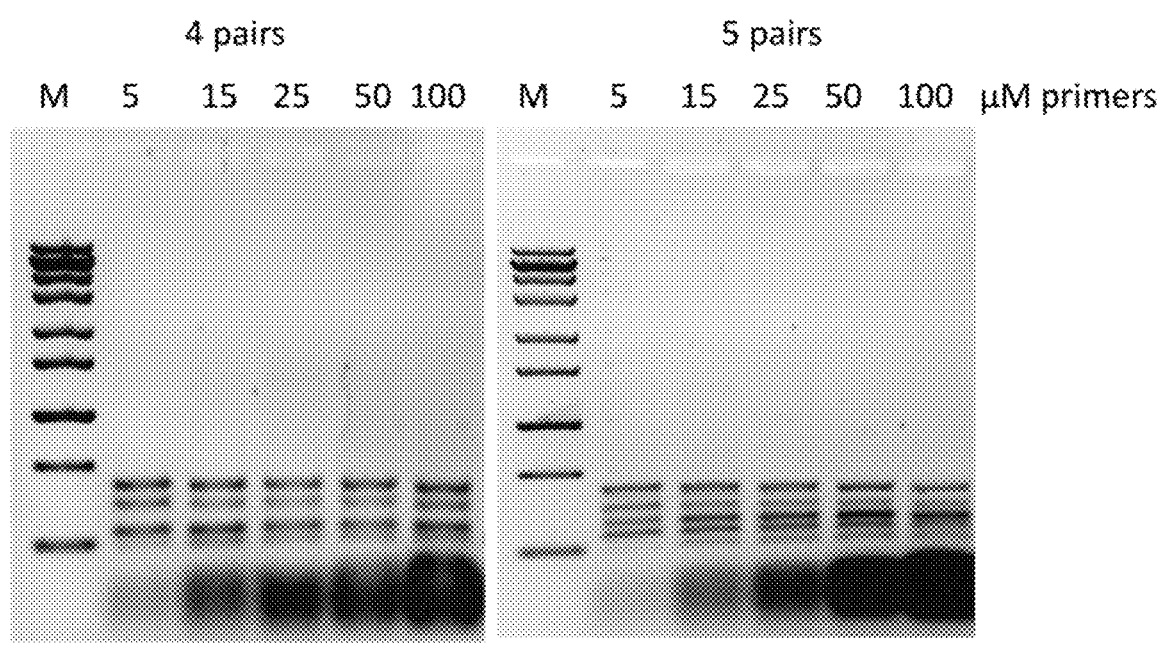
FIG. 16 shows multiplex amplification of human genomic DNA with 4 or 5 primer pairs.

Example 7. Performance of 36H 408S 762Q DNA Polymerase in Multiplex Reactions and Tolerance of High Primer Concentration The tolerance of high primer concentration of the 36H 408S 762Q DNA polymerase was assessed by amplifying regions of human gnomic DNA template with 4 or 5 primer pairs in a multiplex PCR reaction. 8 ng of human genomic DNA template was used in 20 μl PCR reactions. Total primer concentration 5 μM to 100 μM was tested (FIG. 16). Primers with the following sequences were used:

```
99 bp amplicon
(forward)
                                  (SEQ ID NO: 172)
CCCACAGTTGGTAGGCATCA (reverse)
                                  (SEQ ID NO: 173)
TTGCTCAGCAACAAGTTGGC 131 bp amplicon
(forward)
                                  (SEQ ID NO: 174)
TCATGTTGGACGGATGGCTG (reverse)
                                  (SEQ ID NO: 175)
CGGGCTGTCTTCATCACCTC 160 bp amplicon
(forward)
                                  (SEQ ID NO: 176)
ACCATGTGAGACGCTAATCCA (reverse)
                                  (SEQ ID NO: 122)
ACCTGGGAGGCTTTTCTGTA 199 bp amplicon
(forward)
                                  (SEQ ID NO: 123)
GTTTATGGAGGTCCTCTTGTGTCC (reverse)
                                  (SEQ ID NO: 124)
GGGTCAACGCTAGGCTGGCAG 250 bp amplicon
(forward)
                                  (SEQ ID NO: 125)
TCTGGACGGGCATCTCAAGT (reverse)
                                  (SEQ ID NO: 126)
TTCACAGGAAGCACTCACCA
```

The PCR program was as follows:

| 98° C. | 30 s | |
|---|---|---|
| 98° C. | 10 s | |
| 65° C. | 10 s | ×30 |
| 72° C. | 6 s | |

Products were analyzed by agarose gel electrophoresis and stained as in Example 6.

With both 4 and 5 primer pairs, all PCR products were detectable, indicating that the 36H 408S 762Q DNA polymerase tolerated high primer concentrations (FIG. 16). Reasonably even amplification was observed using multiple primer pairs, thus making this polymerase suitable for various multiplex PCR applications, for example, amplification of DNA for next-generation sequencing.

Table of Sequences

| SEQ ID NO | Description | Sequence |
|---|---|---|
| 1 | pfu DNA polymerase (GenBank Acc. No. WP_011011325.1) amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHPDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TRQVGLTSWL NIKKS |
| 2 | Pfu GenBank WP_011011325.1 R762X amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHPDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH |

| SEQ ID NO | Description | Sequence |
|---|---|---|
|  |  | VAVAKKLAAK GVKIKPGMVI GYIVLRGDGP ISNRAILAEE YDPKKHKYDA EYYIENQVLP AVLRILEGFG YRKEDLRYQK TXQVGLTSWL NIKKS; wherein X is selected from Q, N, H, S, T, Y, C, M, W, A, I, L, F, V, P, and G; in some embodiments, X is selected from Q and N. |
| 3 | Pfu GenBank WP_011011325.1 R762Q amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGLTSWL NIKKS |
| 4 | Pfu GenBank WP_011011325.1 A408S R762X amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TXQVGLTSWL NIKKS; wherein X is selected from Q, N, H, S, T, Y, C, M, W, A, I, L, F, V, P, and G; in some embodiments, X is selected from Q and N. |
| 5 | Pfu GenBank WP_011011325.1 A408S R762Q amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGLTSWL NIKKS |

| SEQ ID NO | Description | Sequence |
|---|---|---|
| 6 | Pfu DNA polymerase (GenBank Acc. No. WP_011011325.1), catalytic domain amino acid sequence | SYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TRQVGL |
| 7 | Pfu DNA polymerase (GenBank Acc. No. WP_011011325.1) catalytic domain R762X amino acid sequence | SYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TXQVGL; wherein X is selected from Q, N, H, S, T, Y, C, M, W, A, I, L, F, V, P, and G; in some embodiments, X is selected from Q and N. |
| 8 | Pfu DNA polymerase (GenBank Acc. No. WP_011011325.1) catalytic domain A408S R762X amino acid sequence | SYTGGFV KEPEKGLWEN IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TXQVGL; wherein X is selected from Q, N, H, S, T, Y, C, M, W, A, I, L, F, V, P, and G; in some embodiments, X is selected from Q and N. |
| 9 | Pfu DNA polymerase (GenBank Acc. No. WP_011011325.1) catalytic domain R762Q amino acid sequence | SYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGL |
| 10 | Pfu DNA polymerase (GenBank Acc. No. WP_011011325.1) catalytic domain A408S R762Q amino acid sequence | SYTGGFV KEPEKGLWEN IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGL |
| 11 | Pfu GenBank WP_011011325.1 R762X with DNA binding domain amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL |

| SEQ ID NO | Description | Sequence |
|---|---|---|
| | | DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TXQVGLTSWL NIKKSGTGGG GATVKFKYKG EEKEVDISKI KKVWRVGKMI SFTYDEGGGK TGRGAVSEKD APKELLQMLE KQKK; wherein X is selected from Q, N, H, S, T, Y, C, M, W, A, I, L, F, V, P, and G; in some embodiments, X is selected from Q and N. |
| 12 | Pfu GenBank WP_011011325.1 R762Q with DNA binding domain amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGLTSWL NIKKSGTGGG GATVKFKYKG EEKEVDISKI KKVWRVGKMI SFTYDEGGGK TGRGAVSEKD APKELLQMLE KQKK |
| 13 | Pfu GenBank WP_011011325.1 A408S R762X with DNA binding domain amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TXQVGLTSWL NIKKSGTGGG GATVKFKYKG EEKEVDISKI KKVWRVGKMI SFTYDEGGGK TGRGAVSEKD APKELLQMLE KQKK; wherein X is selected from Q, N, H, S, T, Y, C, M, W, A, I, L, F, V, P, and G; in some embodiments, X is selected from Q and N. |
| 14 | Pfu GenBank WP_011011325.1 A408S R762Q with DNA binding domain amino acid sequence | MILDVDYITE EGKPVIRLFK KENGKFKIEH DRTFRPYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN |

-continued

Table of Sequences

| SEQ ID NO | Description | Sequence |
|---|---|---|
|  |  | IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGLTSWL NIKKSGTGGG GATVKFKYKG EEKEVDISKI KKVWRVGKMI SFTYDEGGGK TGRGAVSEKD APKELLQMLE KQKK |
| 15 | *Pyrococcus* K762X catalytic domain amino acid sequence | SYAGGFVKEP EKGLWENIVS LDFRALYPSI IITHNVSPDT LNREGCRNYD VAPEVGHKFC KDFPGFIPSL LKRLLDERQK IKTKMKASQD PIEKIMLDYR QRAIKILANS YYGYYGYAKA RWYCKECAES VTAWGREYIE FVWKELEEKF GFKVLYIDTD GLYATIPGGK SEEIKKKALE FVDYINAKLP GLLELEYEGF YKRGFFVTKK KYALIDEEGK IITRGLEIVR RDWSEIAKET QARVLEAILK HGNVEEAVRI VKEVTQKLSK YEIPPEKLAI YEQITRPLHE YKAIGPHVAV AKRLAAKGVK IKPGMVIGYI VLRGDGPISN RAILAEEYDP RKHKYDAEYY IENQVLPAVL RILEGFGYRK EDLRWQKTXQ TGL; wherein X is selected from Q, N, H, S, T, Y, C, M, W, A, I, L, F, V, P, and G; in some embodiments, X is selected from Q and N. |
| 16 | *Pyrococcus* A408S K762X catalytic domain amino acid sequence | SYAGGFVKEP EKGLWENIVS LDFRSLYPSI IITHNVSPDT LNREGCRNYD VAPEVGHKFC KDFPGFIPSL LKRLLDERQK IKTKMKASQD PIEKIMLDYR QRAIKILANS YYGYYGYAKA RWYCKECAES VTAWGREYIE FVWKELEEKF GFKVLYIDTD GLYATIPGGK SEEIKKKALE FVDYINAKLP GLLELEYEGF YKRGFFVTKK KYALIDEEGK IITRGLEIVR RDWSEIAKET QARVLEAILK HGNVEEAVRI VKEVTQKLSK YEIPPEKLAI YEQITRPLHE YKAIGPHVAV AKRLAAKGVK IKPGMVIGYI VLRGDGPISN RAILAEEYDP RKHKYDAEYY IENQVLPAVL RILEGFGYRK EDLRWQKTXQ TGL; wherein X is selected from Q, N, H, S, T, Y, C, M, W, A, I, L, F, V, P, and G; in some embodiments, X is selected from Q and N. |
| 17 | *Pyrococcus* K762Q catalytic domain amino acid sequence | SYAGGFVKEP EKGLWENIVS LDFRALYPSI IITHNVSPDT LNREGCRNYD VAPEVGHKFC KDFPGFIPSL LKRLLDERQK IKTKMKASQD PIEKIMLDYR QRAIKILANS YYGYYGYAKA RWYCKECAES VTAWGREYIE FVWKELEEKF GFKVLYIDTD GLYATIPGGK SEEIKKKALE FVDYINAKLP GLLELEYEGF YKRGFFVTKK KYALIDEEGK IITRGLEIVR RDWSEIAKET QARVLEAILK HGNVEEAVRI VKEVTQKLSK YEIPPEKLAI YEQITRPLHE YKAIGPHVAV AKRLAAKGVK IKPGMVIGYI VLRGDGPISN RAILAEEYDP RKHKYDAEYY IENQVLPAVL RILEGFGYRK EDLRWQKTQQ TGL |
| 18 | *Pyrococcus* 408S K762Q catalytic domain amino acid sequence | SYAGGFVKEP EKGLWENIVS LDFRSLYPSI IITHNVSPDT LNREGCRNYD VAPEVGHKFC KDFPGFIPSL LKRLLDERQK IKTKMKASQD PIEKIMLDYR QRAIKILANS YYGYYGYAKA RWYCKECAES VTAWGREYIE FVWKELEEKF GFKVLYIDTD GLYATIPGGK SEEIKKKALE FVDYINAKLP GLLELEYEGF YKRGFFVTKK KYALIDEEGK IITRGLEIVR RDWSEIAKET QARVLEAILK HGNVEEAVRI VKEVTQKLSK YEIPPEKLAI YEQITRPLHE YKAIGPHVAV AKRLAAKGVK IKPGMVIGYI VLRGDGPISN RAILAEEYDP RKHKYDAEYY IENQVLPAVL RILEGFGYRK EDLRWQKTQQ TGL |
| 76 | *Pyrococcus* DNA polymerase sequence including exonuclease domain and catalytic domain, K762X | MILDADYITE EGKPVIRLFK KENGEFKIEH DRTFRPYIYA LLKDDSKIEE VKKITAERHG KIVRIVDABK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN |

| SEQ ID NO | Description | Sequence |
|---|---|---|
| | | IVSLDFRALY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TXQTGL; wherein X is selected from Q, N, H, S, T, Y, C, M, W, A, I, L, F, V, P, and G; in some embodiments, X is selected from Q and N. |
| 77 | *Pyrococcus* DNA polymerase sequence including exonuclease domain and catalytic domain, A408S K762X | MILDADYITE EGKPVIRLFK KENGEFKIEH DRTFRPYIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRSLY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TXQTGL; wherein X is selected from Q, N, H, S, T, Y, C, M, W, A, I, L, F, V, P, and G; in some embodiments, X is selected from Q and N. |
| 78 | *Pyrococcus* DNA polymerase sequence including exonuclease domain and catalytic domain, K762Q | MILDADYITE EGKPVIRLFK KENGEFKIEH DRTFRPYIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRALY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TQQTGL |
| 79 | *Pyrococcus* DNA polymerase sequence including exonuclease domain and catalytic domain, A408S K762Q | MILDADYITE EGKPVIRLFK KENGEFKIEH DRTFRPYIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRSLY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK |

| SEQ ID NO | Description | Sequence |
|---|---|---|
| | | ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TQQTGL |
| 19 | *Pyrococcus* DNA polymerase sequence including exonuclease domain and DNA binding domain, K762X | MILDADYITE EGKPVIRLFK KENGEFKIEH DRTFRPYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TXQTGLTSWL NIKKSGTGGG GATVKFKYKG EEKEVDISKI<br>KKVWRVGKMI SFTYDEGGGK TGRGAVSEKD APKELLQMLE<br>KQKK;<br>wherein X is selected from Q, N, H, S, T, Y,<br>C, M, W, A, I, L, F, V, P, and G; in some<br>embodiments, X is selected from Q and N. |
| 20 | *Pyrococcus* DNA polymerase sequence including exonuclease domain and DNA binding domain, K762Q | MILDADYITE EGKPVIRLFK KENGEFKIEH DRTFRPYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TQQTGLTSWL NIKKSGTGGG GATVKFKYKG EEKEVDISKI<br>KKVWRVGKMI SFTYDEGGGK TGRGAVSEKD APKELLQMLE<br>KQKK |
| 21 | *Pyrococcus* DNA polymerase sequence including exonuclease domain and DNA binding domain, A408S K762X | MILDADYITE EGKPVIRLFK KENGEFKIEH DRTFRPYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRSLY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH |

| Table of Sequences | | |
|---|---|---|
| SEQ ID NO | Description | Sequence |
| | | VAVAKRLAAK GVKIKPGMVI GYIVLRGDGP ISNRAILAEE YDPRKHKYDA EYYIENQVLP AVLRILEGFG YRKEDLRWQK TXQTGLTSWL NIKKSGTGGG GATVKFKYKG EEKEVDISKI KKVWRVGKMI SFTYDEGGGK TGRGAVSEKD APKELLQMLE KQKK; wherein X is selected from Q, N, H, S, T, Y, C, M, W, A, I, L, F, V, P, and G; in some embodiments, X is selected from Q and N. |
| 22 | Pyrococcus DNA polymerase sequence including exonuclease domain and sequence non-specific DNA binding domain, A408S K762Q | MILDADYITE EGKPVIRLFK KENGEFKIEH DRTFRPYIYA LLKDDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRSLY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TQQTGLTSWL NIKKSGTGGG GATVKFKYKG EEKEVDISKI KKVWRVGKMI SFTYDEGGGK TGRGAVSEKD APKELLQMLE KQKK |
| 23 | K762X variant of Deep Vent DNA polymerase amino acid sequence | MILDADYITE DGKPIIRIFK KENGEFKVEY DRNFRPYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TXQTGLTAWL NIKKK; wherein X is selected from Q, N, H, S, T, Y, C, M, W, A, I, L, F, V, P, and G; in some embodiments, X is selected from Q and N. |
| 24 | K762Q variant of Deep Vent DNA polymerase amino acid sequence | MILDADYITE DGKPIIRIFK KENGEFKVEY DRNFRPYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH |

| SEQ ID NO | Description | Sequence |
|---|---|---|
| | | VAVAKRLAAR GVKVRPGMVI GYIVLRGDGP ISKRAILAEE FDLRKHKYDA EYYIENQVLP AVLRILEAFG YRKEDLRWQK TQQTGLTAWL NIKKK |
| 25 | K762X variant of Deep Vent DNA polymerase catalytic domain amino acid sequence | SYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TXQTGL; wherein X is selected from Q, N, H, S, T, Y, C, M, W, A, I, L, F, V, P, and G; in some embodiments, X is selected from Q and N. |
| 26 | K762Q variant of Deep Vent DNA polymerase catalytic domain amino acid sequence | SYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TQQTGL |
| 27 | K762X variant of Deep Vent DNA polymerase amino acid sequence with DNA binding domain | MILDADYITE DGKPIIRIFK KENGEFKVEY DRNFRPYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TXQTGLTAWL NIKKKGTGGG GATVKFKYKG EEKEVDISKI KKVWRVGKMI SFTYDEGGGK TGRGAVSEKD APKELLQMLE KQKK; wherein X is selected from Q, N, H, S, T, Y, C, M, W, A, I, L, F, V, P, and G; in some embodiments, X is selected from Q and N. |
| 28 | K762Q variant of Deep Vent DNA polymerase amino acid sequence with DNA binding domain | MILDADYITE DGKPIIRIFK KENGEFKVEY DRNFRPYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE |

| SEQ ID NO | Description | Sequence |
|---|---|---|
| | | FDLRKHKYDA EYYIENQVLP AVLRILEAFG YRKEDLRWQK TQQTGLTAWL NIKKKGTGGG GATVKFKYKG EEKEVDISKI KKVWRVGKMI SFTYDEGGGK TGRGAVSEKD APKELLQMLE KQKK |
| 29 | K762X K775S variant of Deep Vent DNA polymerase amino acid sequence with sequence non-specific DNA binding domain | MILDADYITE DGKPIIRIFK KENGEFKVEY DRNFRPYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TXQTGLTAWL NIKKSGTGGG GATVKFKYKG EEKEVDISKI KKVWRVGKMI SFTYDEGGGK TGRGAVSEKD APKELLQMLE KQKK; wherein X is selected from Q, N, H, S, T, Y, C, M, W, A, I, L, F, V, P, and G; in some embodiments, X is selected from Q and N. |
| 30 | K762Q K775S variant of Deep Vent DNA polymerase amino acid sequence with sequence non-specific DNA binding domain | MILDADYITE DGKPIIRIFK KENGEFKVEY DRNFRPYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TQQTGLTAWL NIKKSGTGGG GATVKFKYKG EEKEVDISKI KKVWRVGKMI SFTYDEGGGK TGRGAVSEKD APKELLQMLE KQKK |
| 31 | K764X variant of Thermococcus litoralis DNA polymerase | MILDTDYITK DGKPIIRIFK KENGEFKIEL DPHFQPYIYA LLKDDSAIEE IKAIKGERHG KTVRVLDAVK VRKKFLGREV EVWKLIFEHP QDVPAMRGKI REHPAVVDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKEHPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYARNELA PNKPDEEEYK RRLRTTYLGG YVKEPEKGLW ENIIYLDFRS LYPSIIVTHN VSPDTLEKEG CKNYDVAPIV GYRFCKDFPG FIPSILGDLI AMRQDIKKKM KSTIDPIEKK MLDYRQRAIK LLANSYYGYM GYPKARWYSK ECAESVTAWG RHYIEMTIRE IEEKFGFKVL YADTDGFYAT IPGEKPELIK KKAKEFLNYI NSKLPGLLEL EYEGFYLRGF FVTKKRYAVI DEEGRITTRG LEVVRRDWSE IAKETQAKVL EAILKEGSVE KAVEVVRDVV EKIAKYRVPL EKLVIHEQIT RDLKDYKAIG PHVAIAKRLA ARGIKVKPGT IISYIVLKGS GKISDRVILL TEYDPRKHKY DPDYYIENQV LPAVLRILEA FGYRKEDLRY |

| SEQ ID NO | Description | Sequence |
|---|---|---|
| | | QSSXQTGLDA WLKR;<br>wherein X is selected from Q, N, H, S, T, Y, C, M, W, A, I, L, F, V, P, and G; in some embodiments, X is selected from Q and N. |
| 32 | K764Q variant of *Thermococcus litoralis* DNA polymerase | MILDTDYITK DGKPIIRIFK KENGEFKIEL DPHFQPYIYA LLKDDSAIEE IKAIKGERHG KTVRVLDAVK VRKKFLGREV EVWKLIFEHP QDVPAMRGKI REHPAVVDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKEHPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYARNELA PNKPDEEEYK RRLRTTYLGG YVKEPEKGLW ENIIYLDFRS LYPSIIVTHN VSPDTLEKEG CKNYDVAPIV GYRFCKDFPG FIPSILGDLI AMRQDIKKKM KSTIDPIEKK MLDYRQRAIK LLANSYYGYM GYPKARWYSK ECAESVTAWG RHYIEMTIRE IEEKFGFKVL YADTDGFYAT IPGEKPELIK KKAKEFLNYI NSKLPGLLEL EYEGFYLRGF FVTKKRYAVI DEEGRITTRG LEVVRRDWSE IAKETQAKVL EAILKEGSVE KAVEVVRDVV EKIAKYRVPL EKLVIHEQIT RDLKDYKAIG PHVAIAKRLA ARGIKVKPGT IISYIVLKGS GKISDRVILL TEYDPRKHKY DPDYYIENQV LPAVLRILEA FGYRKEDLRY QSSQQTGLDA WLKR |
| 33 | K764X variant of *Thermococcus litoralis* DNA polymerase catalytic domain amino acid sequence | TYLGG YVKEPEKGLW ENIIYLDFRS LYPSIIVTHN VSPDTLEKEG CKNYDVAPIV GYRFCKDFPG FIPSILGDLI AMRQDIKKKM KSTIDPIEKK MLDYRQRAIK LLANSYYGYM GYPKARWYSK ECAESVTAWG RHYIEMTIRE IEEKFGFKVL YADTDGFYAT IPGEKPELIK KKAKEFLNYI NSKLPGLLEL EYEGFYLRGF FVTKKRYAVI DEEGRITTRG LEVVRRDWSE IAKETQAKVL EAILKEGSVE KAVEVVRDVV EKIAKYRVPL EKLVIHEQIT RDLKDYKAIG PHVAIAKRLA ARGIKVKPGT IISYIVLKGS GKISDRVILL TEYDPRKHKY DPDYYIENQV LPAVLRILEA FGYRKEDLRY QSSXQTGL;<br>wherein X is selected from Q, N, H, S, T, Y, C, M, W, A, I, L, F, V, P, and G; in some embodiments, X is selected from Q and N. |
| 34 | K764Q variant of *Thermococcus litoralis* DNA polymerase catalytic domain amino acid sequence | TYLGG YVKEPEKGLW ENIIYLDFRS LYPSIIVTHN VSPDTLEKEG CKNYDVAPIV GYRFCKDFPG FIPSILGDLI AMRQDIKKKM KSTIDPIEKK MLDYRQRAIK LLANSYYGYM GYPKARWYSK ECAESVTAWG RHYIEMTIRE IEEKFGFKVL YADTDGFYAT IPGEKPELIK KKAKEFLNYI NSKLPGLLEL EYEGFYLRGF FVTKKRYAVI DEEGRITTRG LEVVRRDWSE IAKETQAKVL EAILKEGSVE KAVEVVRDVV EKIAKYRVPL EKLVIHEQIT RDLKDYKAIG PHVAIAKRLA ARGIKVKPGT IISYIVLKGS GKISDRVILL TEYDPRKHKY DPDYYIENQV LPAVLRILEA FGYRKEDLRY QSSQQTGL |
| 35 | K764X variant of *Thermococcus litoralis* DNA polymerase, sequence 2 (acc. ADK47977.1) | MILDTDYITK DGKPIIRIFK KENGEFKIEL DPHFQPYIYA LLKDDSAIEE IKAIKGERHG KSVRVVDAVK VKKKFLGREV EVWKLIFEHP QDVPAMRDKI KEHPAVIDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKENPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYERNELA PNKPDEEEYK RRLRTTYLGG YVKEPEKGLW ENIIYLDFRS LYPSIIVTHN VSPDTLEKEG CENYDIAPIV SYRFCKDFPG FIPSILGDLI AMRQEIKKKM KATIDPVERK MLDYRQRAVK LLANSYYGYM GYPKARWYSK ECAESVTAWG RHYIEMTIKE IEEKFGFKVL YADTDGFYAT ISGEKPEIIK KKAREFLNYI NSKLPGLLEL EYEGFYLRGF FVTKKRYAVI DEEGRITTRG LEVVRRDWSE IAKETQAKVL EAILKDGSVE KAVEIVRDVL EKIAKYRVPL EKLVIHEQIT RDLKDYKAIG |

| SEQ ID NO | Description | Sequence |
|---|---|---|
| | | PHVAIAKRLA ARGIKVKPGT IISYIVLKGS GKISDRVILL TEYDPEKHKY DPDYYIENQV LPAVLRILEA FGYRKEDLRY QSSXQTGLDA WLKR;<br>wherein X is selected from Q, N, H, S, T, Y, C, M, W, A, I, L, F, V, P, and G; in some embodiments, X is selected from Q and N. |
| 36 | K764Q variant of *Thermococcus litoralis* DNA polymerase, sequence 2 (acc. ADK47977.1) | MILDTDYITK DGKPIIRIFK KENGEFKIEL DPHFQPYIYA LLKDDSAIEE IKAIKGERHG KSVRVVDAVK VKKKFLGREV EVWKLIFEHP QDVPAMRDKI KEHPAVIDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKENPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYERNELA PNKPDEEEYK RRLRTTYLGG YVKEPEKGLW ENIIYLDFRS LYPSIIVTHN VSPDTLEKEG CENYDIAPIV SYRFCKDFPG FIPSILGDLI AMRQEIKKKM KATIDPVERK MLDYRQRAVK LLANSYYGYM GYPKARWYSK ECAESVTAWG RHYIEMTIKE IEEKFGFKVL YADTDGFYAT ISGEKPEIIK KKAREFLNYI NSKLPGLLEL EYEGFYLRGF FVTKKRYAVI DEEGRITTRG LEVVRRDWSE IAKETQAKVL EAILKDGSVE KAVEIVRDVL EKIAKYRVPL EKLVIHEQIT RDLKDYKAIG PHVAIAKRLA ARGIKVKPGT IISYIVLKGS GKISDRVILL TEYDPEKHKY DPDYYIENQV LPAVLRILEA FGYRKEDLRY QSSQQTGLDA WLKR |
| 37 | K764X variant of *Thermococcus litoralis* DNA polymerase, sequence 2 (acc. ADK47977.1), catalytic domain amino acid sequence | TYLGG YVKEPEKGLW ENIIYLDFRS LYPSIIVTHN VSPDTLEKEG CENYDIAPIV SYRFCKDFPG FIPSILGDLI AMRQEIKKKM KATIDPVERK MLDYRQRAVK LLANSYYGYM GYPKARWYSK ECAESVTAWG RHYIEMTIKE IEEKFGFKVL YADTDGFYAT ISGEKPEIIK KKAREFLNYI NSKLPGLLEL EYEGFYLRGF FVTKKRYAVI DEEGRITTRG LEVVRRDWSE IAKETQAKVL EAILKDGSVE KAVEIVRDVL EKIAKYRVPL EKLVIHEQIT RDLKDYKAIG PHVAIAKRLA ARGIKVKPGT IISYIVLKGS GKISDRVILL TEYDPEKHKY DPDYYIENQV LPAVLRILEA FGYRKEDLRY QSSXQTGL;<br>wherein X is selected from Q, N, H, S, T, Y, C, M, W, A, I, L, F, V, P, and G; in some embodiments, X is selected from Q and N. |
| 38 | K764Q variant of *Thermococcus litoralis* DNA polymerase, sequence 2 (acc. ADK47977.1), catalytic domain amino acid sequence | TYLGG YVKEPEKGLW ENIIYLDFRS LYPSIIVTHN VSPDTLEKEG CENYDIAPIV SYRFCKDFPG FIPSILGDLI AMRQEIKKKM KATIDPVERK MLDYRQRAVK LLANSYYGYM GYPKARWYSK ECAESVTAWG RHYIEMTIKE IEEKFGFKVL YADTDGFYAT ISGEKPEIIK KKAREFLNYI NSKLPGLLEL EYEGFYLRGF FVTKKRYAVI DEEGRITTRG LEVVRRDWSE IAKETQAKVL EAILKDGSVE KAVEIVRDVL EKIAKYRVPL EKLVIHEQIT RDLKDYKAIG PHVAIAKRLA ARGIKVKPGT IISYIVLKGS GKISDRVILL TEYDPEKHKY DPDYYIENQV LPAVLRILEA FGYRKEDLRY QSSQQTGL |
| 39 | R761X variant of *Thermococcus gorgonarius* DNA polymerase | MILDTDYITE DGKPVIRIFK KENGEFKIDY DRNFEPYIYA LLKDDSAIED VKKITAERHG TTVRVVRAEK VKKKFLGRPI EVWKLYFTHP QDVPAIRDKI KEHPAVVDIY EYDIPFAKRY LIDKGLIPME GDEELKMLAF DIETLYHEGE EFAEGPILMI SYADEEGARV ITWKNIDLPY VDVVSTEKEM IKRFLKVVKE KDPDVLITYN GDNFDFAYLK KRSEKLGVKF ILGREGSEPK IQRMGDRFAV EVKGRIHFDL YPVIRRTINL PTYTLEAVYE AIFGQPKEKV YAEEIAQAWE TGEGLERVAR YSMEDAKVTY ELGKEFFPME AQLSRLVGQS LWDVSRSSTG NLVEWFLLRK AYERNELAPN KPDERELARR RESYAGGYVK EPERGLWENI VYLDFRSLYP SIIITHNVSP DTLNREGCEE YDVAPQVGHK FCKDFPGFIP SLLGDLLEER QKVKKKMKAT IDPIEKKLLD YRQRAIKILA NSFYGYYGYA KARWYCKECA ESVTAWGRQY IETTIREIEE KFGFKVLYAD TDGFFATIPG ADAETVKKKA KEFLDYINAK LPGLLELEYE GFYKRGFFVT KKKYAVIDEE DKITTRGLEI VRRDWSEIAK ETQARVLEAI LKHGDVEEAV RIVKEVTEKL SKYEVPPEKL VIYEQITRDL KDYKATGPHV AVAKRLAARG IKIRPGTVIS YIVLKGSGRI GDRAIPFDEF DPAKHKYDAE YYIENQVLPA VERILRAFGY RKEDLRYQKT XQVGLGAWLK PKT; |

Table of Sequences

| SEQ ID NO | Description | Sequence |
|---|---|---|
| | | wherein X is selected from Q, N, H, S, T, Y, C, M, W, A, I, L, F, V, P, and G; in some embodiments, X is selected from Q and N. |
| 40 | R761Q variant of *Thermococcus gorgonarius* DNA polymerase | MILDTDYITE DGKPVIRIFK KENGEFKIDY DRNFEPYIYA LLKDDSAIED VKKITAERHG TTVRVVRAEK VKKKFLGRPI EVWKLYFTHP QDVPAIRDKI KEHPAVVDIY EYDIPFAKRY LIDKGLIPME GDEELKMLAF DIETLYHEGE EFAEGPILMI SYADEEGARV ITWKNIDLPY VDVVSTEKEM IKRFLKVVKE KDPDVLITYN GDNFDFAYLK KRSEKLGVKF ILGREGSEPK IQRMGDRFAV EVKGRIHFDL YPVIRRTINL PTYTLEAVYE AIFGQPKEKV YAEEIAQAWE TGEGLERVAR YSMEDAKVTY ELGKEFFPME AQLSRLVGQS LWDVSRSSTG NLVEWFLLRK AYERNELAPN KPDERELARR RESYAGGYVK EPERGLWENI VYLDFRSLYP SIIITHNVSP DTLNREGCEE YDVAPQVGHK FCKDFPGFIP SLLGDLLEER QKVKKKMKAT IDPIEKKLLD YRQRAIKILA NSFYGYYGYA KARWYCKECA ESVTAWGRQY IETTIREIEE KFGFKVLYAD TDGFFATIPG ADAETVKKKA KEFLDYINAK LPGLLELEYE GFYKRGFFVT KKKYAVIDEE DKITTRGLEI VRRDWSEIAK ETQARVLEAI LKHGDVEEAV RIVKEVTEKL SKYEVPPEKL VIYEQITRDL KDYKATGPHV AVAKRLAARG IKIRPGTVIS YIVLKGSGRI GDRAIPFDEF DPAKHKYDAE YYIENQVLPA VERILRAFGY RKEDLRYQKT QQVGLGAWLK PKT |
| 41 | R761X variant of *Thermococcus gorgonarius* DNA polymerase, catalytic domain amino acid sequence | SYAGGYVK EPERGLWENI VYLDFRSLYP SIIITHNVSP DTLNREGCEE YDVAPQVGHK FCKDFPGFIP SLLGDLLEER QKVKKKMKAT IDPIEKKLLD YRQRAIKILA NSFYGYYGYA KARWYCKECA ESVTAWGRQY IETTIREIEE KFGFKVLYAD TDGFFATIPG ADAETVKKKA KEFLDYINAK LPGLLELEYE GFYKRGFFVT KKKYAVIDEE DKITTRGLEI VRRDWSEIAK ETQARVLEAI LKHGDVEEAV RIVKEVTEKL SKYEVPPEKL VIYEQITRDL KDYKATGPHV AVAKRLAARG IKIRPGTVIS YIVLKGSGRI GDRAIPFDEF DPAKHKYDAE YYIENQVLPA VERILRAFGY RKEDLRYQKT XQVGL; wherein X is selected from Q, N, H, S, T, Y, C, M, W, A, I, L, F, V, P, and G; in some embodiments, X is selected from Q and N. |
| 42 | R761Q variant of *Thermococcus gorgonarius* DNA polymerase, catalytic domain amino acid sequence | SYAGGYVK EPERGLWENI VYLDFRSLYP SIIITHNVSP DTLNREGCEE YDVAPQVGHK FCKDFPGFIP SLLGDLLEER QKVKKKMKAT IDPIEKKLLD YRQRAIKILA NSFYGYYGYA KARWYCKECA ESVTAWGRQY IETTIREIEE KFGFKVLYAD TDGFFATIPG ADAETVKKKA KEFLDYINAK LPGLLELEYE GFYKRGFFVT KKKYAVIDEE DKITTRGLEI VRRDWSEIAK ETQARVLEAI LKHGDVEEAV RIVKEVTEKL SKYEVPPEKL VIYEQITRDL KDYKATGPHV AVAKRLAARG IKIRPGTVIS YIVLKGSGRI GDRAIPFDEF DPAKHKYDAE YYIENQVLPA VERILRAFGY RKEDLRYQKT QQVGL |
| 43 | R761X variant of *Thermococcus kodakarensis* DNA polymerase | MILDTDYITE DGKPVIRIFK KENGEFKIEY DRTFEPYFYA LLKDDSAIEE VKKITAERHG TVVTVKRVEK VQKKFLGRPV EVWKLYFTHP QDVPAIRDKI REHPAVIDIY EYDIPFAKRY LIDKGLVPME GDEELKMLAF DIETLYHEGE EFAEGPILMI SYADEEGARV ITWKNVDLPY VDVVSTEREM IKRFLRVVKE KDPDVLITYN GDNFDFAYLK KRCEKLGINF ALGRDGSEPK IQRMGDRFAV EVKGRIHFDL YPVIRRTINL PTYTLEAVYE AVFGQPKEKV YAEEITTAWE TGENLERVAR YSMEDAKVTY ELGKEFLPME AQLSRLIGQS LWDVSRSSTG NLVEWFLLRK AYERNELAPN KPDEKELARR RQSYEGGYVK EPERGLWENI VYLDFRSLYP SIIITHNVSP DTLNREGCKE YDVAPQVGHR FCKDFPGFIP SLLGDLLEER QKIKKKMKAT IDPIERKLLD YRQRAIKILA NSYYGYYGYA RARWYCKECA ESVTAWGREY ITMTIKEIEE KYGFKVIYSD TDGFFATIPG ADAETVKKKA MEFLKYINAK LPGALELEYE GFYKRGFFVT KKKYAVIDEE GKITTRGLEI VRRDWSEIAK ETQARVLEAL LKDGDVEKAV RIVKEVTEKL SKYEVPPEKL VIHEQITRDL KDYKATGPHV AVAKRLAARG VKIRPGTVIS YIVLKGSGRI GDRAIPFDEF DPTKHKYDAE YYIENQVLPA VERILRAFGY RKEDLRYQKT XQVGLSAWLK PKGT; wherein X is selected from Q, N, H, S, T, Y, C, M, W, A, I, L, F, V, P, and G; in some embodiments, X is selected from Q and N. |

| | | |
|---|---|---|
| SEQ ID NO | Description | Sequence |
| 44 | R761Q variant of *Thermococcus kodakarensis* DNA polymerase | MILDTDYITE DGKPVIRIFK KENGEFKIEY DRTFEPYFYA LLKDDSAIEE VKKITAERHG TVVTVKRVEK VQKKFLGRPV EVWKLYFTHP QDVPAIRDKI REHPAVIDIY EYDIPFAKRY LIDKGLVPME GDEELKMLAF DIETLYHEGE EFAEGPILMI SYADEEGARV ITWKNVDLPY VDVVSTEREM IKRFLRVVKE KDPDVLITYN GDNFDFAYLK KRCEKLGINF ALGRDGSEPK IQRMGDRFAV EVKGRIHFDL YPVIRRTINL PTYTLEAVYE AVFGQPKEKV YAEEITTAWE TGENLERVAR YSMEDAKVTY ELGKEFLPME AQLSRLIGQS LWDVSRSSTG NLVEWFLLRK AYERNELAPN KPDEKELARR RQSYEGGYVK EPERGLWENI VYLDFRSLYP SIIITHNVSP DTLNREGCKE YDVAPQVGHR FCKDFPGFIP SLLGDLLEER QKIKKKMKAT IDPIERKLLD YRQRAIKILA NSYYGYYGYA RARWYCKECA ESVTAWGREY ITMTIKEIEE KYGFKVIYSD TDGFFATIPG ADAETVKKKA MEFLKYINAK LPGALELEYE GFYKRGFFVT KKKYAVIDEE GKITTRGLEI VRRDWSEIAK ETQARVLEAL LKDGDVEKAV RIVKEVTEKL SKYEVPPEKL VIHEQITRDL KDYKATGPHV AVAKRLAARG VKIRPGTVIS YIVLKGSGRI GDRAIPFDEF DPTKHKYDAE YYIENQVLPA VERILRAFGY RKEDLRYQKT QQVGLSAWLK PKGT |
| 45 | R761X variant of *Thermococcus kodakarensis* DNA polymerase, catalytic domain amino acid sequence | SYEGGYVK EPERGLWENI VYLDFRSLYP SIIITHNVSP DTLNREGCKE YDVAPQVGHR FCKDFPGFIP SLLGDLLEER QKIKKKMKAT IDPIERKLLD YRQRAIKILA NSYYGYYGYA RARWYCKECA ESVTAWGREY ITMTIKEIEE KYGFKVIYSD TDGFFATIPG ADAETVKKKA MEFLKYINAK LPGALELEYE GFYKRGFFVT KKKYAVIDEE GKITTRGLEI VRRDWSEIAK ETQARVLEAL LKDGDVEKAV RIVKEVTEKL SKYEVPPEKL VIHEQITRDL KDYKATGPHV AVAKRLAARG VKIRPGTVIS YIVLKGSGRI GDRAIPFDEF DPTKHKYDAE YYIENQVLPA VERILRAFGY RKEDLRYQKT XQVGL; wherein X is selected from Q, N, H, S, T, Y, C, M, W, A, I, L, F, V, P, and G; in some embodiments, X is selected from Q and N. |
| 46 | R761Q variant of *Thermococcus kodakarensis* DNA polymerase, catalytic domain amino acid sequence | SYEGGYVK EPERGLWENI VYLDFRSLYP SIIITHNVSP DTLNREGCKE YDVAPQVGHR FCKDFPGFIP SLLGDLLEER QKIKKKMKAT IDPIERKLLD YRQRAIKILA NSYYGYYGYA RARWYCKECA ESVTAWGREY ITMTIKEIEE KYGFKVIYSD TDGFFATIPG ADAETVKKKA MEFLKYINAK LPGALELEYE GFYKRGFFVT KKKYAVIDEE GKITTRGLEI VRRDWSEIAK ETQARVLEAL LKDGDVEKAV RIVKEVTEKL SKYEVPPEKL VIHEQITRDL KDYKATGPHV AVAKRLAARG VKIRPGTVIS YIVLKGSGRI GDRAIPFDEF DPTKHKYDAE YYIENQVLPA VERILRAFGY RKEDLRYQKT QQVGL |
| 47 | K761X variant of *Thermococcus species* 9o N-7 DNA polymerase, catalytic domain amino acid sequence | GYAGGYVK EPERGLWDNI VYLDFRSLYP SIIITHNVSP DTLNREGCKE YDVAPEVGHK FCKDFPGFIP SLLGDLLEER QKIKRKMKAT VDPLEKKLLD YRQRAIKILA NSFYGYYGYA KARWYCKECA ESVTAWGREY IEMVIRELEE KFGFKVLYAD TDGLHATIPG ADAETVKKKA KEFLKYINPK LPGLLELEYE GFYVRGFFVT KKKYAVIDEE GKITTRGLEI VRRDWSEIAK ETQARVLEAI LKHGDVEEAV RIVKEVTEKL SKYEVPPEKL VIHEQITRDL RDYKATGPHV AVAKRLAARG VKIRPGTVIS YIVLKGSGRI GDRAIPADEF DPTKHRYDAE YYIENQVLPA VERILKAFGY RKEDLRYQKT XQVGL; wherein X is selected from Q, N, H, S, T, Y, C, M, W, A, I, L, F, V, P, and G; in some embodiments, X is selected from Q and N. |
| 48 | K761Q variant of *Thermococcus species* 9o N-7 DNA polymerase, catalytic domain amino acid sequence | GYAGGYVK EPERGLWDNI VYLDFRSLYP SIIITHNVSP DTLNREGCKE YDVAPEVGHK FCKDFPGFIP SLLGDLLEER QKIKRKMKAT VDPLEKKLLD YRQRAIKILA NSFYGYYGYA KARWYCKECA ESVTAWGREY IEMVIRELEE KFGFKVLYAD TDGLHATIPG ADAETVKKKA KEFLKYINPK LPGLLELEYE GFYVRGFFVT KKKYAVIDEE GKITTRGLEI VRRDWSEIAK ETQARVLEAI LKHGDVEEAV RIVKEVTEKL SKYEVPPEKL VIHEQITRDL RDYKATGPHV AVAKRLAARG VKIRPGTVIS YIVLKGSGRI GDRAIPADEF DPTKHRYDAE YYIENQVLPA VERILKAFGY RKEDLRYQKT QQVGL |

| Table of Sequences | | |
|---|---|---|
| SEQ ID NO | Description | Sequence |
| 49 | K761X variant of *Thermococcus species* 9o N-7 DNA polymerase | MILDTDYITE NGKPVIRVFK KENGEFKIEY DRTFEPYFYA LLKDDSAIED VKKVTAKRHG TVVKVKRAEK VQKKFLGRPI EVWKLYFNHP QDVPAIRDRI RAHPAVVDIY EYDIPFAKRY LIDKGLIPME GDEELTMLAF DIETLYHEGE EFGTGPILMI SYADGSEARV ITWKKIDLPY VDVVSTEKEM IKRFLRVVRE KDPDVLITYN GDNFDFAYLK KRCEELGIKF TLGRDGSEPK IQRMGDRFAV EVKGRIHFDL YPVIRRTINL PTYTLEAVYE AVFGKPKEKV YAEEIAQAWE SGEGLERVAR YSMEDAKVTY ELGREFFPME AQLSRLIGQS LWDVSRSSTG NLVEWFLLRK AYKRNELAPN KPDERELARR RGGYAGGYVK EPERGLWDNI VYLDFRSLYP SIIITHNVSP DTLNREGCKE YDVAPEVGHK FCKDFPGFIP SLLGDLLEER QKIKRKMKAT VDPLEKKLLD YRQRAIKILA NSFYGYYGYA KARWYCKECA ESVTAWGREY IEMVIRELEE KFGFKVLYAD TDGLHATIPG ADAETVKKKA KEFLKYINPK LPGLLELEYE GFYVRGFFVT KKKYAVIDEE GKITTRGLEI VRRDWSEIAK ETQARVLEAI LKHGDVEEAV RIVKEVTEKL SKYEVPPEKL VIHEQITRDL RDYKATGPHV AVAKRLAARG VKIRPGTVIS YIVLKGSGRI GDRAIPADEF DPTKHRYDAE YYIENQVLPA VERILKAFGY RKEDLRYQKT XQVGLGAWLK VKGKK; wherein X is selected from Q, N, H, S, T, Y, C, M, W, A, I, L, F, V, P, and G; in some embodiments, X is selected from Q and N. |
| 50 | K761Q variant of *Thermococcus species* 9o N-7 DNA polymerase | MILDTDYITE NGKPVIRVFK KENGEFKIEY DRTFEPYFYA LLKDDSAIED VKKVTAKRHG TVVKVKRAEK VQKKFLGRPI EVWKLYFNHP QDVPAIRDRI RAHPAVVDIY EYDIPFAKRY LIDKGLIPME GDEELTMLAF DIETLYHEGE EFGTGPILMI SYADGSEARV ITWKKIDLPY VDVVSTEKEM IKRFLRVVRE KDPDVLITYN GDNFDFAYLK KRCEELGIKF TLGRDGSEPK IQRMGDRFAV EVKGRIHFDL YPVIRRTINL PTYTLEAVYE AVFGKPKEKV YAEEIAQAWE SGEGLERVAR YSMEDAKVTY ELGREFFPME AQLSRLIGQS LWDVSRSSTG NLVEWFLLRK AYKRNELAPN KPDERELARR RGGYAGGYVK EPERGLWDNI VYLDFRSLYP SIIITHNVSP DTLNREGCKE YDVAPEVGHK FCKDFPGFIP SLLGDLLEER QKIKRKMKAT VDPLEKKLLD YRQRAIKILA NSFYGYYGYA KARWYCKECA ESVTAWGREY IEMVIRELEE KFGFKVLYAD TDGLHATIPG ADAETVKKKA KEFLKYINPK LPGLLELEYE GFYVRGFFVT KKKYAVIDEE GKITTRGLEI VRRDWSEIAK ETQARVLEAI LKHGDVEEAV RIVKEVTEKL SKYEVPPEKL VIHEQITRDL RDYKATGPHV AVAKRLAARG VKIRPGTVIS YIVLKGSGRI GDRAIPADEF DPTKHRYDAE YYIENQVLPA VERILKAFGY RKEDLRYQKT QQVGLGAWLK VKGKK |
| 51 | E775Q variant of *Pyrobaculum calidifontis* DNA polymerase | MRFWPLDATY SVVGGVPEVR VFGVDGEGRR VVLVDRRFRP YFYAKCDKCD ASLAKSYLSR VAPVEAVEVV ERRFFGRPTI FLKVVAKVPE DVRKLREAAL GAPGVVDVYE ADIRYYMRYM IDKGVVPCAW NVVEAREAGK LGPLPLYEVV EWAGVEEGFP PPLRVLAFDI EVYNERGSPD PLRDPVVMLA VKTSDGREEV FEAEGRDDRR VIRGFVDFVK EFDPDVIVGY NSNGFDWPYL SERAKALGVP LRVDRLGGVP QQSVYGHWSV VGRANVDLYN IVDEFPEIKV KTLDRVAEYF GVMKRSERVL IPGHKVYEYW NDPAKRPTLM RYVLDDVRST LGLAEKLLPF LIQLSSVSGL PLDQVAAASV GNRVEWMLLR YAYRMGEVAP NREEREYEPY KGAIVLEPKP GLYSDVLVLD FSSMYPNIMM KYNLSPDTYL EPHEPDPPEG VVVAPEVGHR FRKAPTGFIP AVLKHLVELR RAVREEAKKY PPDSPEYRLL DERQRALKVM ANAMYGYLGW VGARWYKKEV AESVTAFARA ILLDVVEYAK RLGIEVIYGD TDSLFVKKSG AVDRLVKYVE ERHGIEIKVD KDYERVLFTE AKKRYAGLLR DGRIDIVGFE VVRGDWCELA KEVQLNVVEL ILKSKSVGEA RERVVKYVRE VVERLKAYKF DLDDDLIIWKT LDKELDEYKA YGPHVHAALE LKRRGYKVGK GTTVGYVIVR GPGKVSERAM PYIFVDDASK VDVDYYIEKQ VIPAALRIAE VLGVKESDLK TGRVQKSLLD FLG |
| 52 | E778Q variant of *Pyrobaculum aerophilum* DNA polymerase | MKFKLWPLDA TYSVVGGVPE VRIFGISESG DRVVVVDRRF RPYFYADCPA CDPESVRSQL GRVAPVEEVV AVERRYLGRP RSFLKIVARV PEDVRKLREA AAALPGVSGV YEADIRFYMR YMLDMGVVPC SWNTVDAEAT GEKLGNLPVY KVAEWGGVTE GFPPPLRVLA FDIEVYNERG TPDPLRDPVI LLAVQASDGR VEVFEASGRD DRSVLRSFID FVREFDPDVI VGYNSNQFDW |

Table of Sequences

| SEQ ID NO | Description | Sequence |
|---|---|---|
| | | PYLAERARAL GIPLKVDRVG GAPQQSVYGH WSVTGRANVD LYNIVDEFPE IKLKTLDRVA EYFGVMKREE RVLVPGHKIY EYWRDQGKRP LLRQYVIDDV KSTYGLAEKL LPFLIQLSSV SGLPLDQVAA ASVGNRVEWM LLRYAYRLGE VAPNREEREY EPYKGAIVLE PRPGLYSDVL ALDFSSMYPN IMMKYNLSPD TYLERGEPDP PGGVYVAPEV GHRFRREPPG FIPLVLRQLI ELRKRVREEL KKYPPDSPEY RVLDERQRAL KIMANAMYGY TGWVGARWYK KEVAESVTAF ARAILKDVIE YARKAGIVVI YGDTDSLFVK KSGDVEKLVK YVEEKYGIDI KIDKDYSTVL FTEAKKRYAG LLRDGRIDIV GFEVVRGDWS ELAKEVQLRV IELILTSRDV SEARQKVVKY VRGVIDKLRN YEVDLDDLII WKTLDKELDE YKAYPPHVHA AILLKKRGYK VGKGTTIGYV VVKGGEKVSE RAVPYIFIDD IEKIDLDYYV ERQVIPAALR IAEVIGIKEG DLKTGRSQRT LLDFF |
| 53 | Sso7d SNS-dsDBD amino acid sequence of *Sulfolobus solfataricus* (see U.S. Pat. No. 6,627,424) | ATVKFKYKGE EKEVDISKIK KVWRVGKMIS FTYDEGGGKT GRGAVSEKDA PKELLQMLEK QKK |
| 54 | Sac7d SNS-dsDBD amino acid sequence of *Sulfolobus acidocaldarius* | VKVKFKYKGE EKEVDTSKIK KVWRVGKMVS FTYDDNGKTG RGAVSEKDAP KELLDMLARA EREKK |
| 55 | *Pyrobaculum aerophilum* Pae3192 amino acid sequence | SKKQKLKFYD IKAKQAFETD QYEVIEKQTA RGPMMFAVAK SPYTGIKVYR LLGKKK |
| 56 | *Pyrobaculum aerophilum* Pae0384 amino acid sequence | AKQKLKFYDI KAKQSFETDK YEVIEKETAR GPMLFAVATS PYTGIKVYRL LGKKK |
| 57 | *Aeropyrum pernix* Ape3192 amino acid sequence | PKKEKIKFFD LVAKKYYETD NYEVEIKETK RGKFRFAKAK SPYTGKIFYR VLGKA |
| 58 | HMfA HMf family archaeal histone amino acid sequence of *Methanothermus fervidus* | GELPIAPIGR IIKNAGAERV SDDARIALAK VLEEMGEEIA SEAVKLAKHA GRKTIKAED |
| 59 | HMfB HMf family archaeal histone amino acid sequence of *Methanothermus fervidus* | ELPIAPIGRI IKDAGAERVS DDARITLAKI LEEMGRDIAS EAIKLARHAG RKTIKAEDI |
| 60 | HpyA1 HMf family archaeal histone amino acid sequence of *Pyrococcus* strain GB-3a | GELPIAPVDR LIRKAGAERV SEEAAKILAE YLEEYAIEVS KKAVEFARHA GRKTVKAED |
| 61 | HpyA2 HMf family archaeal histone amino acid sequence of *Pyrococcus* strain GB-3a | AELPIAPVDR LIRKAGAQRV SEQAAKLLAE HLEEKALEIA RKAVDLAKHA GRKTVKAED |
| 62 | Sso7d sequence non-specific DNA-binding domain amino acid sequence | ATVKFKYKGE EKEVDISKIK KVWRVGKMIS FTYDEGGGKT GRGAVSEKDA PKELLQMLEK QK |
| 63 | *Pyrococcus* 3'-5' exonuclease domain amino acid sequence | EELKLLAFDI ETLYHEGEEF GKGPIIMISY ADEEEAKVIT WKKIDLPYVE VVSSEREMIK RFLKIIREKD PDIIITYNGD SFDLPYLAKR AEKLGIKLTI GRDGSEPKMQ RIGDMTAVEV KGRIHFDLYH VIRRTINLPT YTLEAVYEAI FGKPKEKVYA DEIAKAWETG EGLERVAKYS MEDAKATYEL GKEF |
| 64 | PCR Primer nucleotide sequence | GAAGAGCCAAGGACAGGTAC |
| 65 | PCR Primer nucleotide sequence | CCTCCAAATCAAGCCTCTAC |
| 66 | PCR Primer nucleotide sequence | CAGTGCAGTGCTTGATAACAGG |
| 67 | PCR Primer nucleotide sequence | GTAGTGCGCGTTTGATTTCC |
| 68 | PCR Primer nucleotide sequence | CCTGCTCTGCCGCTTCACGC |

| Table of Sequences | | |
|---|---|---|
| SEQ ID NO | Description | Sequence |
| 69 | PCR Primer nucleotide sequence | CGAACGTCGCGCAGAGAAACAGG |
| 70 | PCR Primer nucleotide sequence | CTGATGAGTTCGTGTCCGTACAACTGGCGTAATC |
| 71 | PCR Primer nucleotide sequence | GTGCACCATGCAACATGAATAACAGTGGGTTATC |
| 72 | PCR Primer nucleotide sequence | GGGCGTTTTCCGTAACACTG |
| 73 | PCR Primer nucleotide sequence | TGACCACATACAATCGCCGT |
| 74 | PCR Primer nucleotide sequence | CTCCACAGGGTGAGGTCTAAGTGATGACA |
| 75 | PCR Primer nucleotide sequence | CAATCTCAGGGCAAGTTAAGGGAATAGTG |
| 80 | Pfu GenBank WP_011011325.1 P36H R762X$^2$ amino acid sequence | MILDVDYITE EGKPVIRLFK KENGKFKIEH DRTFRHYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TX$^2$QVGLTSWL NIKKS;<br>wherein X$^2$ is selected from Q, N, H, S, T, Y, C, M, W, A, I, L, F, V, P, and G; in some embodiments, X$^2$ is selected from Q and N. |
| 81 | Pfu GenBank WP_011011325.1 P36H R762Q amino acid sequence | MILDVDYITE EGKPVIRLFK KENGKFKIEH DRTFRHYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGLTSWL NIKKS |
| 82 | Pfu GenBank WP_011011325.1 P36H A408S R762X$^2$ amino acid sequence | MILDVDYITE EGKPVIRLFK KENGKFKIEH DRTFRHYIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK |

| SEQ ID NO | Description | Sequence |
|---|---|---|
| | | MQRIGDMTAV EVKGRIHFDL YHVITRTINL PTYTLEAVYE<br>AIFGKPKEKV YADEIAKAWE SGENLERVAK YSMEDAKATY<br>ELGKEFLPME IQLSRLVGQP LWDVSRSSTG NLVEWFLLRK<br>AYERNEVAPN KPSEEEYQRR LRESYTGGFV KEPEKGLWEN<br>IVYLDFRSLY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TX$^2$QVGLTSWL NIKKS;<br>wherein X$^2$ is selected from Q, N, H, S, T, Y, C, M, W, A, I, L, F, V, P, and G; in some embodiments, X$^2$ is selected from Q and N. |
| 83 | Pfu GenBank WP_011011325.1 P36H A408S R762Q amino acid sequence | MILDVDYITE EGKPVIRLFK KENGKFKIEH DRTFRHYIYA<br>LLRDDSKIEE VKKITGERHG KIVRIVDVEK VEKKFLGKPI<br>TVWKLYLEHP QDVPTIREKV REHPAVVDIF EYDIPFAKRY<br>LIDKGLIPME GEEELKILAF DIETLYHEGE EFGKGPIIMI<br>SYADENEAKV ITWKNIDLPY VEVVSSEREM IKRFLRIIRE<br>KDPDIIVTYN GDSFDFPYLA KRAEKLGIKL TIGRDGSEPK<br>MQRIGDMTAV EVKGRIHFDL YHVITRTINL PTYTLEAVYE<br>AIFGKPKEKV YADEIAKAWE SGENLERVAK YSMEDAKATY<br>ELGKEFLPME IQLSRLVGQP LWDVSRSSTG NLVEWFLLRK<br>AYERNEVAPN KPSEEEYQRR LRESYTGGFV KEPEKGLWEN<br>IVYLDFRSLY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TQQVGLTSWL NIKKS |
| 84 | Pfu GenBank WP_011011325.1 P36H R762X$^2$ with DNA binding domain amino acid sequence | MILDVDYITE EGKPVIRLFK KENGKFKIEH DRTFRHYIYA<br>LLRDDSKIEE VKKITGERHG KIVRIVDVEK VEKKFLGKPI<br>TVWKLYLEHP QDVPTIREKV REHPAVVDIF EYDIPFAKRY<br>LIDKGLIPME GEEELKILAF DIETLYHEGE EFGKGPIIMI<br>SYADENEAKV ITWKNIDLPY VEVVSSEREM IKRFLRIIRE<br>KDPDIIVTYN GDSFDFPYLA KRAEKLGIKL TIGRDGSEPK<br>MQRIGDMTAV EVKGRIHFDL YHVITRTINL PTYTLEAVYE<br>AIFGKPKEKV YADEIAKAWE SGENLERVAK YSMEDAKATY<br>ELGKEFLPME IQLSRLVGQP LWDVSRSSTG NLVEWFLLRK<br>AYERNEVAPN KPSEEEYQRR LRESYTGGFV KEPEKGLWEN<br>IVYLDFRALY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TX$^2$QVGLTSWL NIKKSGTGGG GATVKFKYKG EEKEVDISKI<br>KKVWRVGKMI SFTYDEGGGK TGRGAVSEKD APKELLQMLE<br>KQKK;<br>wherein X$^2$ is selected from Q, N, H, S, T, Y, C, M, W, A, I, L, F, V, P, and G; in some embodiments, X$^2$ is selected from Q and N. |
| 85 | Pfu GenBank WP_011011325.1 P36H R762Q with DNA binding domain amino acid sequence | MILDVDYITE EGKPVIRLFK KENGKFKIEH DRTFRHYIYA<br>LLRDDSKIEE VKKITGERHG KIVRIVDVEK VEKKFLGKPI<br>TVWKLYLEHP QDVPTIREKV REHPAVVDIF EYDIPFAKRY<br>LIDKGLIPME GEEELKILAF DIETLYHEGE EFGKGPIIMI<br>SYADENEAKV ITWKNIDLPY VEVVSSEREM IKRFLRIIRE<br>KDPDIIVTYN GDSFDFPYLA KRAEKLGIKL TIGRDGSEPK<br>MQRIGDMTAV EVKGRIHFDL YHVITRTINL PTYTLEAVYE<br>AIFGKPKEKV YADEIAKAWE SGENLERVAK YSMEDAKATY |

| SEQ ID NO | Description | Sequence |
|---|---|---|
| | | ELGKEFLPME IQLSRLVGQP LWDVSRSSTG NLVEWFLLRK<br>AYERNEVAPN KPSEEEYQRR LRESYTGGFV KEPEKGLWEN<br>IVYLDFRALY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TQQVGLTSWL NIKKSGTGGG GATVKFKYKG EEKEVDISKI<br>KKVWRVGKMI SFTYDEGGGK TGRGAVSEKD APKELLQMLE<br>KQKK |
| 86 | Pfu GenBank WP_011011325.1 P36H A408S R762X$^2$ with DNA binding domain amino acid sequence | MILDVDYITE EGKPVIRLFK KENGKFKIEH DRTFRHYIYA<br>LLRDDSKIEE VKKITGERHG KIVRIVDVEK VEKKFLGKPI<br>TVWKLYLEHP QDVPTIREKV REHPAVVDIF EYDIPFAKRY<br>LIDKGLIPME GEEELKILAF DIETLYHEGE EFGKGPIIMI<br>SYADENEAKV ITWKNIDLPY VEVVSSEREM IKRFLRIIRE<br>KDPDIIVTYN GDSFDFPYLA KRAEKLGIKL TIGRDGSEPK<br>MQRIGDMTAV EVKGRIHFDL YHVITRTINL PTYTLEAVYE<br>AIFGKPKEKV YADEIAKAWE SGENLERVAK YSMEDAKATY<br>ELGKEFLPME IQLSRLVGQP LWDVSRSSTG NLVEWFLLRK<br>AYERNEVAPN KPSEEEYQRR LRESYTGGFV KEPEKGLWEN<br>IVYLDFRSLY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TX$^2$QVGLTSWL NIKKSGTGGG GATVKFKYKG EEKEVDISKI<br>KKVWRVGKMI SFTYDEGGGK TGRGAVSEKD APKELLQMLE<br>KQKK;<br>wherein X$^2$ is selected from Q, N, H, S, T, Y, C, M, W, A, I, L, F, V, P, and G; in some embodiments, X$^2$ is selected from Q and N. |
| 87 | Pfu GenBank WP_011011325.1 P36H A408S R762Q with DNA binding domain amino acid sequence | MILDVDYITE EGKPVIRLFK KENGKFKIEH DRTFRHYIYA<br>LLRDDSKIEE VKKITGERHG KIVRIVDVEK VEKKFLGKPI<br>TVWKLYLEHP QDVPTIREKV REHPAVVDIF EYDIPFAKRY<br>LIDKGLIPME GEEELKILAF DIETLYHEGE EFGKGPIIMI<br>SYADENEAKV ITWKNIDLPY VEVVSSEREM IKRFLRIIRE<br>KDPDIIVTYN GDSFDFPYLA KRAEKLGIKL TIGRDGSEPK<br>MQRIGDMTAV EVKGRIHFDL YHVITRTINL PTYTLEAVYE<br>AIFGKPKEKV YADEIAKAWE SGENLERVAK YSMEDAKATY<br>ELGKEFLPME IQLSRLVGQP LWDVSRSSTG NLVEWFLLRK<br>AYERNEVAPN KPSEEEYQRR LRESYTGGFV KEPEKGLWEN<br>IVYLDFRSLY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TQQVGLTSWL NIKKSGTGGG GATVKFKYKG EEKEVDISKI<br>KKVWRVGKMI SFTYDEGGGK TGRGAVSEKD APKELLQMLE<br>KQKK |
| 88 | *Pyrococcus* DNA polymerase sequence including exonuclease domain and catalytic domain, P36H K762X$^2$ | MILDADYITE EGKPVIRLFK KENGEFKIEH DRTFRHYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK |

-continued

Table of Sequences

| SEQ ID NO | Description | Sequence |
|---|---|---|
| | | AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TX$^2$QTGL;<br>wherein X$^2$ is selected from Q, N, H, S, T, Y,<br>C, M, W, A, I, L, F, V, P, and G; in some<br>embodiments, X$^2$ is selected from Q and N. |
| 89 | *Pyrococcus* DNA polymerase sequence including exonuclease domain and catalytic domain, P36H A408S K762X$^2$ | MILDADYITE EGKPVIRLFK KENGEFKIEH DRTFRHYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRSLY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TX$^2$QTGL;<br>wherein X$^2$ is selected from Q, N, H, S, T, Y,<br>C, M, W, A, I, L, F, V, P, and G; in some<br>embodiments, X$^2$ is selected from Q and N. |
| 90 | *Pyrococcus* DNA polymerase sequence including exonuclease domain and catalytic domain, P36H K762Q | MILDADYITE EGKPVIRLFK KENGEFKIEH DRTFRHYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TQQTGL |
| 91 | *Pyrococcus* DNA polymerase sequence including exonuclease domain and catalytic domain, P36H A408S K762Q | MILDADYITE EGKPVIRLFK KENGEFKIEH DRTFRHYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRSLY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE |

| SEQ ID NO | Description | Sequence |
|---|---|---|
| | | YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TQQTGL |
| 92 | *Pyrococcus* DNA polymerase sequence including exonuclease domain and DNA binding domain, P36H K762X$^2$ | MILDADYITE EGKPVIRLFK KENGEFKIEH DRTFRHYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TX$^2$QTGLTSWL NIKKSGTGGG GATVKFKYKG EEKEVDISKI<br>KKVWRVGKMI SFTYDEGGGK TGRGAVSEKD APKELLQMLE<br>KQKK;<br>wherein X$^2$ is selected from Q, N, H, S, T, Y,<br>C, M, W, A, I, L, F, V, P, and G; in some<br>embodiments, X$^2$ is selected from Q and N. |
| 93 | *Pyrococcus* DNA polymerase sequence including exonuclease domain and DNA binding domain, P36H K762Q | MILDADYITE EGKPVIRLFK KENGEFKIEH DRTFRHYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TQQTGLTSWL NIKKSGTGGG GATVKFKYKG EEKEVDISKI<br>KKVWRVGKMI SFTYDEGGGK TGRGAVSEKD APKELLQMLE<br>KQKK |
| 94 | *Pyrococcus* DNA polymerase sequence including exonuclease domain and DNA binding domain, P36H A408S K762X$^2$ | MILDADYITE EGKPVIRLFK KENGEFKIEH DRTFRHYIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRSLY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA |

Table of Sequences

| SEQ ID NO | Description | Sequence |
|---|---|---|
|  |  | VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TX$^2$QTGLTSWL NIKKSGTGGG GATVKFKYKG EEKEVDISKI KKVWRVGKMI SFTYDEGGGK TGRGAVSEKD APKELLQMLE KQKK;<br>wherein X$^2$ is selected from Q, N, H, S, T, Y, C, M, W, A, I, L, F, V, P, and G; in some embodiments, X$^2$ is selected from Q and N. |
| 95 | *Pyrococcus* DNA polymerase sequence including exonuclease domain and sequence non-specific DNA binding domain, P36H A408S K762Q | MILDADYITE EGKPVIRLFK KENGEFKIEH DRTFRHYIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRSLY PSIIITHNVS PDTLNREGCR NYDVAPEVGH KFCKDFPGFI PSLLKRLLDE RQIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TQQTGLTSWL NIKKSGTGGG GATVKFKYKG EEKEVDISKI KKVWRVGKMI SFTYDEGGGK TGRGAVSEKD APKELLQMLE KQKK |
| 96 | P36H K762X$^2$ variant of Deep Vent DNA polymerase amino acid sequence | MILDADYITE DGKPIIRIFK KENGEFKVEY DRNFRHYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TX$^2$QTGLTAWL NIKKK;<br>wherein X$^2$ is selected from Q, N, H, S, T, Y, C, M, W, A, I, L, F, V, P, and G; in some embodiments, X$^2$ is selected from Q and N. |
| 97 | P36H K762Q variant of Deep Vent DNA polymerase amino acid sequence | MILDADYITE DGKPIIRIFK KENGEFKVEY DRNFRHYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA |

| SEQ ID NO | Description | Sequence |
|---|---|---|
| | | VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TQQTGLTAWL NIKKK |
| 98 | P36H K762X$^2$ variant of Deep Vent DNA polymerase amino acid sequence with DNA binding domain | MILDADYITE DGKPIIRIFK KENGEFKVEY DRNFRHYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TX$^2$QTGLTAWL NIKKKGTGGG GATVKFKYKG EEKEVDISKI KKVWRVGKMI SFTYDEGGGK TGRGAVSEKD APKELLQMLE KQKK; wherein X$^2$ is selected from Q, N, H, S, T, Y, C, M, W, A, I, L, F, V, P, and G; in some embodiments, X$^2$ is selected from Q and N. |
| 99 | P36H K762Q variant of Deep Vent DNA polymerase amino acid sequence with DNA binding domain | MILDADYITE DGKPIIRIFK KENGEFKVEY DRNFRHYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TQQTGLTAWL NIKKKGTGGG GATVKFKYKG EEKEVDISKI KKVWRVGKMI SFTYDEGGGK TGRGAVSEKD APKELLQMLE KQKK |
| 100 | P36H K762X$^2$ K775S variant of Deep Vent DNA polymerase amino acid sequence with sequence non-specific DNA binding domain | MILDADYITE DGKPIIRIFK KENGEFKVEY DRNFRHYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK |

-continued

| | | Table of Sequences | |
|---|---|---|---|
| SEQ ID NO | Description | | Sequence |
| | | | TX$^2$QTGLTAWL NIKKSGTGGG GATVKFKYKG EEKEVDISKI KKVWRVGKMI SFTYDEGGGK TGRGAVSEKD APKELLQMLE KQKK; wherein X$^2$ is selected from Q, N, H, S, T, Y, C, M, W, A, I, L, F, V, P, and G; in some embodiments, X$^2$ is selected from Q and N. |
| 101 | P36H K762Q K775S variant of Deep Vent DNA polymerase amino acid sequence with sequence non-specific DNA binding domain | | MILDADYITE DGKPIIRIFK KENGEFKVEY DRNFRHYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TQQTGLTAWL NIKKSGTGGG GATVKFKYKG EEKEVDISKI KKVWRVGKMI SFTYDEGGGK TGRGAVSEKD APKELLQMLE KQKK |
| 102 | P36H K764X$^2$ variant of *Thermococcus litoralis* DNA polymerase | | MILDTDYITK DGKPIIRIFK KENGEFKIEL DPHFQHYIYA LLKDDSAIEE IKAIKGERHG KTVRVLDAVK VRKKFLGREV EVWKLIFEHP QDVPAMRGKI REHPAVVDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKEHPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYARNELA PNKPDEEEYK RRLRTTYLGG YVKEPEKGLW ENIIYLDFRS LYPSIIVTHN VSPDTLEKEG CKNYDVAPIV GYRFCKDFPG FIPSILGDLI AMRQDIKKKM KSTIDPIEKK MLDYRQRAIK LLANSYYGYM GYPKARWYSK ECAESVTAWG RHYIEMTIRE IEEKFGFKVL YADTDGFYAT IPGEKPELIK KKAKEFLNYI NSKLPGLLEL EYEGFYLRGF FVTKKRYAVI DEEGRITTRG LEVVRRDWSE IAKETQAKVL EAILKEGSVE KAVEVVRDVV EKIAKYRVPL EKLVIHEQIT RDLKDYKAIG PHVAIAKRLA ARGIKVKPGT IISYIVLKGS GKISDRVILL TEYDPRKHKY DPDYYIENQV LPAVLRILEA FGYRKEDLRY QSSX$^2$QTGLDA WLKR; wherein X$^2$ is selected from Q, N, H, S, T, Y, C, M, W, A, I, L, F, V, P, and G; in some embodiments, X$^2$ is selected from Q and N. |
| 103 | P36H K764Q variant of *Thermococcus litoralis* DNA polymerase | | MILDTDYITK DGKPIIRIFK KENGEFKIEL DPHFQHYIYA LLKDDSAIEE IKAIKGERHG KTVRVLDAVK VRKKFLGREV EVWKLIFEHP QDVPAMRGKI REHPAVVDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKEHPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYARNELA PNKPDEEEYK RRLRTTYLGG YVKEPEKGLW ENIIYLDFRS LYPSIIVTHN VSPDTLEKEG CKNYDVAPIV GYRFCKDFPG FIPSILGDLI AMRQDIKKKM KSTIDPIEKK MLDYRQRAIK LLANSYYGYM GYPKARWYSK ECAESVTAWG RHYIEMTIRE IEEKFGFKVL YADTDGFYAT IPGEKPELIK KKAKEFLNYI NSKLPGLLEL EYEGFYLRGF FVTKKRYAVI DEEGRITTRG LEVVRRDWSE IAKETQAKVL EAILKEGSVE KAVEVVRDVV EKIAKYRVPL EKLVIHEQIT RDLKDYKAIG |

| SEQ ID NO | Description | Sequence |
|---|---|---|
| | | PHVAIAKRLA ARGIKVKPGT IISYIVLKGS GKISDRVILL TEYDPRKHKY DPDYYIENQV LPAVLRILEA FGYRKEDLRY QSSQQTGLDA WLKR |
| 104 | P36H K764X$^2$ variant of *Thermococcus litoralis* DNA polymerase, sequence 2 (acc. ADK47977.1) | MILDTDYITK DGKPIIRIFK KENGEFKIEL DPHFQHYIYA LLKDDSAIEE IKAIKGERHG KSVRVVDAVK VKKKFLGREV EVWKLIFEHP QDVPAMRDKI KEHPAVIDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKENPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYERNELA PNKPDEEEYK RRLRTTYLGG YVKEPEKGLW ENIIYLDFRS LYPSIIVTHN VSPDTLEKEG CENYDIAPIV SYRFCKDFPG FIPSILGDLI AMRQEIKKKM KATIDPVERK MLDYRQRAVK LLANSYYGYM GYPKARWYSK ECAESVTAWG RHYIEMTIKE IEEKFGFKVL YADTDGFYAT ISGEKPEIIK KKAREFLNYI NSKLPGLLEL EYEGFYLRGF FVTKKRYAVI DEEGRITTRG LEVVRRDWSE IAKETQAKVL EAILKDGSVE KAVEIVRDVL EKIAKYRVPL EKLVIHEQIT RDLKDYKAIG PHVAIAKRLA ARGIKVKPGT IISYIVLKGS GKISDRVILL TEYDPEKHKY DPDYYIENQV LPAVLRILEA FGYRKEDLRY QSSX$^2$QTGLDA WLKR; wherein X$^2$ is selected from Q, N, H, S, T, Y, C, M, W, A, I, L, F, V, P, and G; in some embodiments, X$^2$ is selected from Q and N. |
| 105 | P36H K764Q variant of *Thermococcus litoralis* DNA polymerase, sequence 2 (acc. ADK47977.1) | MILDTDYITK DGKPIIRIFK KENGEFKIEL DPHFQHYIYA LLKDDSAIEE IKAIKGERHG KSVRVVDAVK VKKKFLGREV EVWKLIFEHP QDVPAMRDKI KEHPAVIDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKENPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYERNELA PNKPDEEEYK RRLRTTYLGG YVKEPEKGLW ENIIYLDFRS LYPSIIVTHN VSPDTLEKEG CENYDIAPIV SYRFCKDFPG FIPSILGDLI AMRQEIKKKM KATIDPVERK MLDYRQRAVK LLANSYYGYM GYPKARWYSK ECAESVTAWG RHYIEMTIKE IEEKFGFKVL YADTDGFYAT ISGEKPEIIK KKAREFLNYI NSKLPGLLEL EYEGFYLRGF FVTKKRYAVI DEEGRITTRG LEVVRRDWSE IAKETQAKVL EAILKDGSVE KAVEIVRDVL EKIAKYRVPL EKLVIHEQIT RDLKDYKAIG PHVAIAKRLA ARGIKVKPGT IISYIVLKGS GKISDRVILL TEYDPEKHKY DPDYYIENQV LPAVLRILEA FGYRKEDLRY QSSQQTGLDA WLKR |
| 106 | P36H R761X$^2$ variant of *Thermococcus gorgonarius* DNA polymerase | MILDTDYITE DGKPVIRIFK KENGEFKIDY DRNFEHYIYA LLKDDSAIED VKKITAERHG TTVRVVRAEK VKKKFLGRPI EVWKLYFTHP QDVPAIRDKI KEHPAVVDIY EYDIPFAKRY LIDKGLIPME GDEELKMLAF DIETLYHEGE EFAEGPILMI SYADEEGARV ITWKNIDLPY VDVVSTEKEM IKRFLKVVKE KDPDVLITYN GDNFDPAYLK KRSEKLGVKF ILGREGSEPK IQRMGDRENV EVKGRIHFDL YPVIRRTINL PTYTLEAVYE AIFGQPKEKV YAEEIAQAWE TGEGLERVAR YSMEDAKVTY ELGKEFFPME AQLSRLVGQS LWDVSRSSTG NLVEWFLLRK AYERNELAPN KPDERELARR RESYAGGYVK EPERGLWENI VYLDFRSLYP SIIITHNVSP DTLNREGCEE YDVAPQVGHK FCKDFPGFIP SLLGDLLEER QKVKKKMKAT IDPIEKKLLD YRQRAIKILA NSFYGYYGYA KARWYCKECA ESVTAWGRQY IETTIREIEE KFGFKVLYAD TDGFFATIPG ADAETVKKKA KEFLDYINAK LPGLLELEYE GFYKRGFFVT KKKYAVIDEE DKITTRGLEI VRRDWSEIAK ETQARVLEAI LKHGDVEEAV RIVKEVTEKL SKYEVPPEKL VIYEQITRDL KDYKATGPHV AVAKRLAARG IKIRPGTVIS YIVLKGSGRI GDRAIPFDEF DPAKHKYDAE YYIENQVLPA VERILRAFGY RKEDLRYQKT X$^2$QVGLGAWLK PKT; wherein X$^2$ is selected from Q, N, H, S, T, Y, C, M, W, A, I, L, F, V, P, and G; in some embodiments, X$^2$ is selected from Q and N. |

-continued

Table of Sequences

| SEQ ID NO | Description | Sequence |
|---|---|---|
| 107 | P36H R761Q variant of *Thermococcus gorgonarius* DNA polymerase | MILDTDYITE DGKPVIRIFK KENGEFKIDY DRNFEHYIYA LLKDDSAIED VKKITAERHG TTVRVVRAEK VKKKFLGRPI EVWKLYFTHP QDVPAIRDKI KEHPAVVDIY EYDIPFAKRY LIDKGLIPME GDEELKMLAF DIETLYHEGE EFAEGPILMI SYADEEGARV ITWKNIDLPY VDVVSTEKEM IKRFLKVVKE KDPDVLITYN GDNFDFAYLK KRSEKLGVKF ILGREGSEPK IQRMGDRENV EVKGRIHFDL YPVIRRTINL PTYTLEAVYE AIFGQPKEKV YAEEIAQAWE TGEGLERVAR YSMEDAKVTY ELGKEFFPME AQLSRLVGQS LWDVSRSSTG NLVEWFLLRK AYERNELAPN KPDERELARR RESYAGGYVK EPERGLWENI VYLDFRSLYP SIIITHNVSP DTLNREGCEE YDVAPQVGHK FCKDFPGFIP SLLGDLLEER QKVKKKMKAT IDPIEKKLLD YRQRAIKILA NSFYGYYGYA KARWYCKECA ESVTAWGRQY IETTIREIEE KFGFKVLYAD TDGFFATIPG ADAETVKKKA KEFLDYINAK LPGLLELEYE GFYKRGFFVT KKKYAVIDEE DKITTRGLEI VRRDWSEIAK ETQARVLEAI LKHGDVEEAV RIVKEVTEKL SKYEVPPEKL VIYEQITRDL KDYKATGPHV AVAKRLAARG IKIRPGTVIS YIVLKGSGRI GDRAIPFDEF DPAKHKYDAE YYIENQVLPA VERILRAFGY RKEDLRYQKT QQVGLGAWLK PKT |
| 108 | P36H R761X$^2$ variant of *Thermococcus kodakarensis* DNA polymerase | MILDTDYITE DGKPVIRIFK KENGEFKIEY DRTFEHYFYA LLKDDSAIEE VKKITAERHG TVVTVKRVEK VQKKFLGRPV EVWKLYFTHP QDVPAIRDKI REHPAVIDIY EYDIPFAKRY LIDKGLVPME GDEELKMLAF DIETLYHEGE EFAEGPILMI SYADEEGARV ITWKNVDLPY VDVVSTEREM IKRFLRVVKE KDPDVLITYN GDNFDFAYLK KRCEKLGINF ALGRDSEPK IQRMGDRFAV EVKGRIHFDL YPVIRRTINL PTYTLEAVYE AVFGQPKEKV YAEEITTAWE TGENLERVAR YSMEDAKVTY ELGKEFLPME AQLSRLIGQS LWDVSRSSTG NLVEWFLLRK AYERNELAPN KPDEKELARR RQSYEGGYVK EPERGLWENI VYLDFRSLYP SIIITHNVSP DTLNREGCKE YDVAPQVGHR FCKDFPGFIP SLLGDLLEER QKIKKKMKAT IDPIERKLLD YRQRAIKILA NSYYGYYGYA RARWYCKECA ESVTAWGREY ITMTIKEIEE KYGFKVIYSD TDGFFATIPG ADAETVKKKA MEFLKYINAK LPGALELEYE GFYKRGFFVT KKKYAVIDEE GKITTRGLEI VRRDWSEIAK ETQARVLEAL LKDGDVEKAV RIVKEVTEKL SKYEVPPEKL VIHEQITRDL KDYKATGPHV AVAKRLAARG VKIRPGTVIS YIVLKGSGRI GDRAIPFDEF DPTKHKYDAE YYIENQVLPA VERILRAFGY RKEDLRYQKT X$^2$QVGLSAWLK PKGT; wherein X$^2$ is selected from Q, N, H, S, T, Y, C, M, W, A, I, L, F, V, P, and G; in some embodiments, X$^2$ is selected from Q and N. |
| 109 | P36H R761Q variant of *Thermococcus kodakarensis* DNA polymerase | MILDTDYITE DGKPVIRIFK KENGEFKIEY DRTFEHYFYA LLKDDSAIEE VKKITAERHG TVVTVKRVEK VQKKFLGRPV EVWKLYFTHP QDVPAIRDKI REHPAVIDIY EYDIPFAKRY LIDKGLVPME GDEELKMLAF DIETLYHEGE EFAEGPILMI SYADEEGARV ITWKNVDLPY VDVVSTEREM IKRFLRVVKE KDPDVLITYN GDNFDFAYLK KRCEKLGINF ALGRDGSEPK IQRMGDRFAV EVKGRIHFDL YPVIRRTINL PTYTLEAVYE AVFGQPKEKV YAEEITTAWE TGENLERVAR YSMEDAKVTY ELGKEFLPME AQLSRLIGQS LWDVSRSSTG NLVEWFLLRK AYERNELAPN KPDEKELARR RQSYEGGYVK EPERGLWENI VYLDFRSLYP SIIITHNVSP DTLNREGCKE YDVAPQVGHR FCKDFPGFIP SLLGDLLEER QKIKKKMKAT IDPIERKLLD YRQRAIKILA NSYYGYYGYA RARWYCKECA ESVTAWGREY ITMTIKEIEE KYGFKVIYSD TDGFFATIPG ADAETVKKKA MEFLKYINAK LPGALELEYE GFYKRGFFVT KKKYAVIDEE GKITTRGLEI VRRDWSEIAK ETQARVLEAL LKDGDVEKAV RIVKEVTEKL SKYEVPPEKL VIHEQITRDL KDYKATGPHV AVAKRLAARG VKIRPGTVIS YIVLKGSGRI GDRAIPFDEF DPTKHKYDAE YYIENQVLPA VERILRAFGY RKEDLRYQKT QQVGLSAWLK PKGT |
| 110 | P36H K761X$^2$ variant of *Thermococcus species* 9o N-7 DNA polymerase | MILDTDYITE NGKPVIRVFK KENGEFKIEY DRTFEHYFYA LLKDDSAIED VKKVTAKRHG TVVKVKRAEK VQKKFLGRPI EVWKLYFNHP QDVPAIRDRI RAHPAVVDIY EYDIPFAKRY LIDKGLIPME GDEELTMLAF DIETLYHEGE EFGTGPILMI SYADGSEARV ITWKKIDLPY VDVVSTEKEM IKRFLRVVRE KDPDVLITYN GDNFDFAYLK KRCEELGIKF TLGRDGSEPK IQRMGDRFAV EVKGRIHFDL YPVIRRTINL PTYTLEAVYE |

-continued

| Table of Sequences | | |
|---|---|---|
| SEQ ID NO | Description | Sequence |
| | | AVFGKPKEKV YAEEIAQAWE SGEGLERVAR YSMEDAKVTY<br>ELGREFFPME AQLSRLIGQS LWDVSRSSTG NLVEWFLLRK<br>AYKRNELAPN KPDERELARR RGGYAGGYVK EPERGLWDNI<br>VYLDFRSLYP SIIITHNVSP DTLNREGCKE YDVAPEVGHK<br>FCKDFPGFIP SLLGDLLEER QKIKRKMKAT VDPLEKKLLD<br>YRQRAIKILA NSFYGYYGYA KARWYCKECA ESVTAWGREY<br>IEMVIRELEE KFGFKVLYAD TDGLHATIPG ADAETVKKKA<br>KEFLKYINPK LPGLLELEYE GFYVRGFFVT KKKYAVIDEE<br>GKITTRGLEI VRRDWSEIAK ETQARVLEAI LKHGDVEEAV<br>RIVKEVTEKL SKYEVPPEKL VIHEQITRDL RDYKATGPHV<br>AVAKRLAARG VKIRPGTVIS YIVLKGSGRI GDRAIPADEF<br>DPTKHRYDAE YYIENQVLPA VERILKAFGY RKEDLRYQKT<br>X$^2$QVGLGAWLK VKGKK;<br>wherein X$^2$ is selected from Q, N, H, S, T, Y, C, M, W, A, I, L, F, V, P, and G; in some embodiments, X$^2$ is selected from Q and N. |
| 111 | P36H K761Q variant of Thermococcus species 9o N-7 DNA polymerase | MILDTDYITE NGKPVIRVFK KENGEFKIEY DRTFEHYFYA<br>LLKDDSAIED VKKVTAKRHG TVVKVKRAEK VQKKFLGRPI<br>EVWKLYFNHP QDVPAIRDRI RAHPAVVDIY EYDIPFAKRY<br>LIDKGLIPME GDEELTMLAF DIETLYHEGE EFGTGPILMI<br>SYADGSEARV ITWKKIDLPY VDVVSTEKEM IKRFLRVVRE<br>KDPDVLITYN GDNFDFAYLK KRCEELGIKF TLGRDGSEPK<br>IQRMGDRFAV EVKGRIHFDL YPVIRRTINL PTYTLEAVYE<br>AVFGKPKEKV YAEEIAQAWE SGEGLERVAR YSMEDAKVTY<br>ELGREFFPME AQLSRLIGQS LWDVSRSSTG NLVEWFLLRK<br>AYKRNELAPN KPDERELARR RGGYAGGYVK EPERGLWDNI<br>VYLDFRSLYP SIIITHNVSP DTLNREGCKE YDVAPEVGHK<br>FCKDFPGFIP SLLGDLLEER QKIKRKMKAT VDPLEKKLLD<br>YRQRAIKILA NSFYGYYGYA KARWYCKECA ESVTAWGREY<br>IEMVIRELEE KFGFKVLYAD TDGLHATIPG ADAETVKKKA<br>KEFLKYINPK LPGLLELEYE GFYVRGFFVT KKKYAVIDEE<br>GKITTRGLEI VRRDWSEIAK ETQARVLEAI LKHGDVEEAV<br>RIVKEVTEKL SKYEVPPEKL VIHEQITRDL RDYKATGPHV<br>AVAKRLAARG VKIRPGTVIS YIVLKGSGRI GDRAIPADEF<br>DPTKHRYDAE YYIENQVLPA VERILKAFGY RKEDLRYQKT<br>QQVGLGAWLK VKGKK |
| 112 | P40H E775Q variant of Pyrobaculum calidifontis DNA polymerase | MRFWPLDATY SVVGGVPEVR VFGVDGEGRR VVLVDRRFRH<br>YFYAKCDKCD ASLAKSYLSR VAPVEAVEVV ERRFFGRPTI<br>FLKVVAKVPE DVRKLREAAL GAPGVVDVYE ADIRYYMRYM<br>IDKGVVPCAW NVVEAREAGK LGPLPLYEVV EWAGVEEGFP<br>PPLRVLAFDI EVYNERGSPD PLRDPVVMLA VKTSDGREEV<br>FEAEGRDDRR VIRGFVDFVK EFDPDVIVGY NSNGFDWPYL<br>SERAKALGVP LRVDRLGGVP QQSVYGHWSV VGRANVDLYN<br>IVDEFPEIKV KTLDRVAEYF GVMKRSERVL IPGHKVYEYW<br>NDPAKRPTLM RYVLDDVRST LGLAEKLLPF LIQLSSVSGL<br>PLDQVAAASV GNRVEWMLLR YAYRMGEVAP NREEREYEPY<br>KGAIVLEPKP GLYSDVLVLD FSSMYPNIMM KYNLSPDTYL<br>EPHEPDPPEG VVVAPEVGHR FRKAPTGFIP AVLKHLVELR<br>RAVREEAKKY PPDSPEYRLL DERQRALKVM ANAMYGYLGW<br>VGARWYKKEV AESVTAFARA ILLDVVEYAK RLGIEVIYGD<br>TDSLFVKKSG AVDRLVKYVE ERHGIEIKVD KDYERVLFTE<br>AKKRYAGLLR DGRIDIVGFE VVRGDWCELA KEVQLNVVEL<br>ILKSKSVGEA RERVVKYVRE VVERLKAYKF DLDDLIIWKT<br>LDKELDEYKA YGPHVHAALE LKRRGYKVGK GTTVGYVIVR<br>GPGKVSERAM PYIFVDDASK VDVDYYIEKQ VIPAALRIAE<br>VLGVKESDLK TGRVQKSLLD FLG |
| 113 | P42H E778Q variant of Pyrobaculum aerophilum DNA polymerase | MKFKLWPLDA TYSVVGGVPE VRIFGISESG DRVVVVDRRF<br>RHYFYADCPA CDPESVRSQL GRVAPVEEVV AVERRYLGRP<br>RSFLKIVARV PEDVRKLREA AALPGVSGV YEADIRFYMR<br>YMLDMGVVPC SWNTVDAEAT GEKLGNLPVY KVAEWGGVTE<br>GFPPPLRVLA FDIEVYNERG TPDPLRDPVI LLAVQASDGR<br>VEVFEASGRD DRSVLRSFID FVREFDPDVI VGYNSNQFDW<br>PYLAERARAL GIPLKVDRVG GAPQQSVYGH WSVTGRANVD<br>LYNIVDEFPE IKLKTLDRVA EYFGVMKREE RVLVPGHKIY<br>EYWRDQGKRP LLRQYVIDDV KSTYGLAEKL LPFLIQLSSV<br>SGLPLDQVAA ASVGNRVEWM LLRYAYRLGE VAPNREEREY<br>EPYKGAIVLE PRPGLYSDVL ALDFSSMYPN IMMKYNLSPD<br>TYLERGEPDP PGGVYVAPEV GHRFRREPPG FIPLVLRQLI<br>ELRKRVREEL KKYPPDSPEY RVLDERQRAL KIMANAMYGY<br>TGWVGARWYK KEVAESVTAF ARAILKDVIE YARKAGIVVI |

-continued

Table of Sequences

| SEQ ID NO | Description | Sequence |
|---|---|---|
| | | YGDTDSLFVK KSGDVEKLVK YVEEKYGIDI KIDKDYSTVL FTEAKKRYAG LLRDGRIDIV GFEVVRGDWS ELAKEVQLRV IELILTSRDV SEARQKVVKY VRGVIDKLRN YEVDLDDLII WKTLDKELDE YKAYPPHVHA AILLKKRGYK VGKGTTIGYV VVKGGEKVSE RAVPYIFIDD IEKIDLDYYV ERQVIPAALR IAEVIGIKEG DLKTGRSQRT LLDFF |
| 114 | Pyrococcus DNA polymerase sequence including exonuclease domain and catalytic domain, P36H | MILDADYITE EGKPVIRLFK KENGEFKIEH DRTFRHYIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIML SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRALY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TKQTGL |
| 115 | Pyrococcus DNA polymerase N-terminal domain comprising a uracil-binding pocket, P36H | MILDADYITE EGKPVIRLFK KENGEFKIEH DRTFRHYIYA LLKDDSKIEE VKKITAERHG KIVRIVDAEK VEKKFLGRPI TVWRLYFEHP QDVPTIREKI REHSAVVDIF EYDIPFAKRY LIDKGLIPME G |
| 116 | Pfu DNA polymerase (GenBank Acc. No. WP_011011325.1) N-terminal domain comprising a uracil-binding pocket, P36H | MILDVDYITE EGKPVIRLFK KENGKFKIEH DRTFRHYIYA LLRDDSKIEE VKKITGERHG KIVRIVDVEK VEKKFLGKPI TVWKLYLEHP QDVPTIREKV REHPAVVDIF EYDIPFAKRY LIDKGLIPME G |
| 117 | Deep Vent DNA polymerase N-terminal domain comprising a uracil-binding pocket, P36H | MILDADYITE DGKPIIRIFK KENGEFKVEY DRNFRHYIYA LLKDDSQIDE VRKITAERHG KIVRIIDAEK VRKKFLGRPI EVWRLYFEHP QDVPAIRDKI REHSAVIDIF EYDIPFAKRY LIDKGLIPME G |
| 118 | Thermococcus litoralis DNA polymerase N-terminal domain comprising a uracil-binding pocket, P36H | MILDTDYITK DGKPIIRIFK KENGEFKIEL DPHFQHYIYA LLKDDSAIEE IKAIKGERHG KTVRVLDAVK VRKKFLGREV EVWKLIFEHP QDVPAMRGKI REHPAVVDIY EYDIPFAKRY LIDKGLIPME G |
| 119 | Thermococcus gorgonarius DNA polymerase N-terminal domain comprising a uracil-binding pocket, P36H | MILDTDYITE DGKPVIRIFK KENGEFKIDY DRNFEHYIYA LLKDDSAIED VKKITAERHG TTVRVVRAEK VKKKFLGRPI EVWKLYFTHP QDVPAIRDKI KEHPAVVDIY EYDIPFAKRY LIDKGLIPME G |
| 120 | Thermococcus kodakarensis DNA polymerase N-terminal domain comprising a uracil-binding pocket, P36H | MILDTDYITE DGKPVIRIFK KENGEFKIEY DRTFEHYFYA LLKDDSAIEE VKKITAERHG TVVTVKRVEK VQKKFLGRPV EVWKLYFTHP QDVPAIRDKI REHPAVIDIY EYDIPFAKRY LIDKGLVPME G |
| 121 | Thermococcus species 9o N-7 DNA polymerase N-terminal domain comprising a uracil-binding pocket, P36H | MILDTDYITE NGKPVIRVFK KENGEFKIEY DRTFEHYFYA LLKDDSAIED VKKVTAKRHG TVVKVKRAEK VQKKFLGRPI EVWKLYFNHP QDVPAIRDRI RAHPAVVDIY EYDIPFAKRY LIDKGLIPME G |
| 127 | Pfu GenBank WP_011011325.1 P36X[1] R762X[2] amino acid sequence | MILDVDYITE EGKPVIRLFK KENGKFKIEH DRTFRX[1]YIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK |

| SEQ ID NO | Description | Sequence |
|---|---|---|
| | | AYERNEVAPN KPSEEEYQRR LRESYTGGFV KEPEKGLWEN<br>IVYLDFRALY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TX$^2$QVGLTSWL NIKKS;<br>wherein X$^1$ is any amino acid other than P; in some embodiments, X$^1$ is selected from Q, N, H, S, T, Y, C, M, W, A, I, L, F, V, G; in some embodiments, X$^1$ is H; and<br>wherein X$^2$ is selected from Q, N, H, S, T, Y, C, M, W, A, I, L, F, V, P, and G; in some embodiments, X$^2$ is selected from Q and N. |
| 128 | Pfu GenBank WP_011011325.1 P36X$^1$ R762Q amino acid sequence | MILDVDYITE EGKPVIRLFK KENGKFKIEH DRTFRX$^1$YIYA<br>LLRDDSKIEE VKKITGERHG KIVRIVDVEK VEKKFLGKPI<br>TVWKLYLEHP QDVPTIREKV REHPAVVDIF EYDIPFAKRY<br>LIDKGLIPME GEEELKILAF DIETLYHEGE EFGKGPIIMI<br>SYADENEAKV ITWKNIDLPY VEVVSSEREM IKRFLRIIRE<br>KDPDIIVTYN GDSFDFPYLA KRAEKLGIKL TIGRDGSEPK<br>MQRIGDMTAV EVKGRIHFDL YHVITRTINL PTYTLEAVYE<br>AIFGKPKEKV YADEIAKAWE SGENLERVAK YSMEDAKATY<br>ELGKEFLPME IQLSRLVGQP LWDVSRSSTG NLVEWFLLRK<br>AYERNEVAPN KPSEEEYQRR LRESYTGGFV KEPEKGLWEN<br>IVYLDFRALY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TQQVGLTSWL NIKKS;<br>wherein X$^1$ is any amino acid other than P; in some embodiments, X$^1$ is selected from Q, N, H, S, T, Y, C, M, W, A, I, L, F, V, G; in some embodiments, X$^1$ is H. |
| 129 | Pfu GenBank WP_011011325.1 P36X$^1$ A408S R762X$^2$ amino acid sequence | MILDVDYITE EGKPVIRLFK KENGKFKIEH DRTFRX$^1$YIYA<br>LLRDDSKIEE VKKITGERHG KIVRIVDVEK VEKKFLGKPI<br>TVWKLYLEHP QDVPTIREKV REHPAVVDIF EYDIPFAKRY<br>LIDKGLIPME GEEELKILAF DIETLYHEGE EFGKGPIIMI<br>SYADENEAKV ITWKNIDLPY VEVVSSEREM IKRFLRIIRE<br>KDPDIIVTYN GDSFDFPYLA KRAEKLGIKL TIGRDGSEPK<br>MQRIGDMTAV EVKGRIHFDL YHVITRTINL PTYTLEAVYE<br>AIFGKPKEKV YADEIAKAWE SGENLERVAK YSMEDAKATY<br>ELGKEFLPME IQLSRLVGQP LWDVSRSSTG NLVEWFLLRK<br>AYERNEVAPN KPSEEEYQRR LRESYTGGFV KEPEKGLWEN<br>IVYLDFRSLY PSIIITHNVS PDTLNLEGCK NYDIAPQVGH<br>KFCKDIPGFI PSLLGHLLEE RQKIKTKMKE TQDPIEKILL<br>DYRQKAIKLL ANSFYGYYGY AKARWYCKEC AESVTAWGRK<br>YIELVWKELE EKFGFKVLYI DTDGLYATIP GGESEEIKKK<br>ALEFVKYINS KLPGLLELEY EGFYKRGFFV TKKRYAVIDE<br>EGKVITRGLE IVRRDWSEIA KETQARVLET ILKHGDVEEA<br>VRIVKEVIQK LANYEIPPEK LAIYEQITRP LHEYKAIGPH<br>VAVAKKLAAK GVKIKPGMVI GYIVLRGDGP ISNRAILAEE<br>YDPKKHKYDA EYYIENQVLP AVLRILEGFG YRKEDLRYQK<br>TX$^2$QVGLTSWL NIKKS;<br>wherein X$^1$ is any amino acid other than P; in some embodiments, X$^1$ is selected from Q, N, H, S, T, Y, C, M, W, A, I, L, F, V, G; in some embodiments, X$^1$ is H; and<br>wherein X$^2$ is selected from Q, N, H, S, T, Y, C, M, W, A, I, L, F, V, P, and G; in some embodiments, X$^2$ is selected from Q and N. |

| SEQ ID NO | Description | Sequence |
|---|---|---|
| 130 | Pfu GenBank WP_011011325.1 P36X[1] A408S R762Q amino acid sequence | MILDVDYITE EGKPVIRLFK KENGKFKIEH DRTFRX[1]YIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGLTSWL NIKKS; wherein X[1] is any amino acid other than P; in some embodiments, X[1] is selected from Q, N, H, S, T, Y, C, M, W, A, I, L, F, V, G; in some embodiments, X[1] is H. |
| 131 | Pfu GenBank WP_011011325.1 P36X[1] R762X[2] with DNA binding domain amino acid sequence | MILDVDYITE EGKPVIRLFK KENGKFKIEH DRTFRX[1]YIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TXQVGLTSWL NIKKSGTGGG GATVKFKYKG EEKEVDISKI KKVWRVGKMI SFTYDEGGGK TGRGAVSEKD APKELLQMLE KQKK; wherein X[1] is any amino acid other than P; in some embodiments, X[1] is selected from Q, N, H, S, T, Y, C, M, W, A, I, L, F, V, G; in some embodiments, X[1] is H; and wherein X[2] is selected from Q, N, H, S, T, Y, C, M, W, A, I, L, F, V, P, and G; in some embodiments, X[2] is selected from Q and N. |
| 132 | Pfu GenBank WP_011011325.1 P36X[1] R762Q with DNA binding domain amino acid sequence | MILDVDYITE EGKPVIRLFK KENGKFKIEH DRTFRX[1]YIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDFPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRALY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH |

-continued

Table of Sequences

| SEQ ID NO | Description | Sequence |
|---|---|---|
| | | VAVAKKLAAK GVKIKPGMVI GYIVLRGDGP ISNRAILAEE YDPKKHKYDA EYYIENQVLP AVLRILEGFG YRKEDLRYQK TQQVGLTSWL NIKKSGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H. |
| 133 | Pfu GenBank WP_011011325.1 P36$X^1$ A408S R762$X^2$ with DNA binding domain amino acid sequence | MILDVDYITE EGKPVIRLFK KENGKFKIEH DRTFR$X^1$YIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDPPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TXQVGLTSWL NIKKSGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H; and wherein $X^2$ is selected from Q, N, H, S, T, Y, C, M, W, A, I, L, F, V, P, and G; in some embodiments, $X^2$ is selected from Q and N. |
| 134 | Pfu GenBank WP_011011325.1 P36$X^1$ A408S R762Q with DNA binding domain amino acid sequence | MILDVDYITE EGKPVIRLFK KENGKFKIEH DRTFR$X^1$YIYA LLRDDSKIEE VKKITGERHG KIVRIVDVEK VEKKFLGKPI TVWKLYLEHP QDVPTIREKV REHPAVVDIF EYDIPFAKRY LIDKGLIPME GEEELKILAF DIETLYHEGE EFGKGPIIMI SYADENEAKV ITWKNIDLPY VEVVSSEREM IKRFLRIIRE KDPDIIVTYN GDSFDPPYLA KRAEKLGIKL TIGRDGSEPK MQRIGDMTAV EVKGRIHFDL YHVITRTINL PTYTLEAVYE AIFGKPKEKV YADEIAKAWE SGENLERVAK YSMEDAKATY ELGKEFLPME IQLSRLVGQP LWDVSRSSTG NLVEWFLLRK AYERNEVAPN KPSEEEYQRR LRESYTGGFV KEPEKGLWEN IVYLDFRSLY PSIIITHNVS PDTLNLEGCK NYDIAPQVGH KFCKDIPGFI PSLLGHLLEE RQKIKTKMKE TQDPIEKILL DYRQKAIKLL ANSFYGYYGY AKARWYCKEC AESVTAWGRK YIELVWKELE EKFGFKVLYI DTDGLYATIP GGESEEIKKK ALEFVKYINS KLPGLLELEY EGFYKRGFFV TKKRYAVIDE EGKVITRGLE IVRRDWSEIA KETQARVLET ILKHGDVEEA VRIVKEVIQK LANYEIPPEK LAIYEQITRP LHEYKAIGPH VAVAKKLAAK GVKIKPGMVI GYIVLRGDGP ISNRAILAEE YDPKKHKYDA EYYIENQVLP AVLRILEGFG YRKEDLRYQK TQQVGLTSWL NIKKSGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H. |
| 135 | *Pyrococcus* DNA polymerase sequence including exonuclease domain and catalytic domain, P36$X^1$ K762$X^2$ | MILDADYITE EGKPVIRLFK KENGEFKIEH DRTFR$X^1$YIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK |

Table of Sequences

| SEQ ID NO | Description | Sequence |
|---|---|---|
| | | MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TXQTGL;<br>wherein $X^1$ is any amino acid other than P; in some embodiments, $X^1$ is selected from Q, N, H, S, T, Y, C, M, W, A, I, L, F, V, G; in some embodiments, $X^1$ is H; and<br>wherein $X^2$ is selected from Q, N, H, S, T, Y, C, M, W, A, I, L, F, V, P, and G; in some embodiments, $X^2$ is selected from Q and N. |
| 136 | Pyrococcus DNA polymerase sequence including exonuclease domain and catalytic domain, P36$X^1$ A408S K762$X^2$ | MILDADYITE EGKPVIRLFK KENGEFKIEH DRTFRX$^1$YIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRSLY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TXQTGL;<br>wherein $X^1$ is any amino acid other than P; in some embodiments, $X^1$ is selected from Q, N, H, S, T, Y, C, M, W, A, I, L, F, V, G; in some embodiments, $X^1$ is H; and<br>wherein $X^2$ is selected from Q, N, H, S, T, Y, C, M, W, A, I, L, F, V, P, and G; in some embodiments, $X^2$ is selected from Q and N. |
| 137 | Pyrococcus DNA polymerase sequence including exonuclease domain and catalytic domain, P36$X^1$ K762Q | MILDADYITE EGKPVIRLFK KENGEFKIEH DRTFRX$^1$YIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE |

| SEQ ID NO | Description | Sequence |
|---|---|---|
| | | YDPRKHKYDA EYYIENQVLP AVLRILEGFG YRKEDLRWQK TQQTGL; wherein $X^1$ is any amino acid other than P; in some embodiments, $X^1$ is selected from Q, N, H, S, T, Y, C, M, W, A, I, L, F, V, G; in some embodiments, $X^1$ is H. |
| 138 | *Pyrococcus* DNA polymerase sequence including exonuclease domain and catalytic domain, P36$X^1$ A408S K762Q | MILDADYITE EGKPVIRLFK KENGEFKIEH DRTFRX$^1$YIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRSLY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TQQTGL; wherein $X^1$ is any amino acid other than P; in some embodiments, $X^1$ is selected from Q, N, H, S, T, Y, C, M, W, A, I, L, F, V, G; in some embodiments, $X^1$ is H. |
| 139 | *Pyrococcus* DNA polymerase sequence including exonuclease domain and DNA binding domain, P36$X^1$ K762$X^2$ | MILDADYITE EGKPVIRLFK KENGEFKIEH DRTFRX$^1$YIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRALY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TXQTGLTSWL NIKKSGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H; wherein $X^2$ is selected from Q, N, H, S, T, Y, C, M, W, A, I, L, F, V, P, and G; in some embodiments, $X^2$ is selected from Q and N. |
| 140 | *Pyrococcus* DNA polymerase sequence including exonuclease domain and DNA binding domain, P36$X^1$ K762Q | MILDADYITE EGKPVIRLFK KENGEFKIEH DRTFRX$^1$YIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRALY PSIIITHNVS PDTLNREGCR NYDVAPEVGH |

| SEQ ID NO | Description | Sequence |
|---|---|---|
| | | KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TQQTGLTSWL NIKKSGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H. |
| 141 | Pyrococcus DNA polymerase sequence including exonuclease domain and DNA binding domain, P36$X^1$ A408S K762$X^2$ | MILDADYITE EGKPVIRLFK KENGEFKIEH DRTFRX$^1$YIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRSLY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TXQTGLTSWL NIKKSGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H; and wherein $X^2$ is selected from Q, N, H, S, T, Y, C, M, W, A, I, L, F, V, P, and G; in some embodiments, $X^2$ is selected from Q and N. |
| 142 | Pyrococcus DNA polymerase sequence including exonuclease domain and sequence non-specific DNA binding domain, P36$X^1$ A408S K762Q | MILDADYITE EGKPVIRLFK KENGEFKIEH DRTFRX$^1$YIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRSLY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TQQTGLTSWL NIKKSGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H. |

| SEQ ID NO | Description | Sequence |
|---|---|---|
| 143 | P36X¹ K762X² variant of Deep Vent DNA polymerase amino acid sequence | MILDADYITE DGKPIIRIFK KENGEFKVEY DRNFRX¹YIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TXQTGLTAWL NIKKK; wherein X¹ is any amino acid other than P; in some embodiments, X¹ is selected from Q, N, H, S, T, Y, C, M, W, A, I, L, F, V, G; in some embodiments, X¹ is H; and wherein X² is selected from Q, N, H, S, T, Y, C, M, W, A, I, L, F, V, P, and G; in some embodiments, X² is selected from Q and N. |
| 144 | P36X¹ K762Q variant of Deep Vent DNA polymerase amino acid sequence | MILDADYITE DGKPIIRIFK KENGEFKVEY DRNFRX¹YIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TQQTGLTAWL NIKKK; wherein X¹ is any amino acid other than P; in some embodiments, X¹ is selected from Q, N, H, S, T, Y, C, M, W, A, I, L, F, V, G; in some embodiments, X¹ is H. |
| 145 | P36X¹ K762X² variant of Deep Vent DNA polymerase amino acid sequence with DNA binding domain | MILDADYITE DGKPIIRIFK KENGEFKVEY DRNFRX¹YIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TXQTGLTAWL NIKKKGTGGG GATVKFKYKG EEKEVDISKI |

| SEQ ID NO | Description | Sequence |
|---|---|---|
| | | KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H; and wherein $X^2$ is selected from Q, N, H, S, T, Y, C, M, W, A, I, L, F, V, P, and G; in some embodiments, $X^2$ is selected from Q and N. |
| 146 | P36$X^1$ K762Q variant of Deep Vent DNA polymerase amino acid sequence with DNA binding domain | MILDADYITE DGKPIIRIFK KENGEFKVEY DRNFRX$^1$YIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TQQTGLTAWL NIKKKGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H. |
| 147 | P36$X^1$ K762$X^2$ K775S variant of Deep Vent DNA polymerase amino acid sequence with sequence non-specific DNA binding domain | MILDADYITE DGKPIIRIFK KENGEFKVEY DRNFRX$^1$YIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TXQTGLTAWL NIKKSGTGGG GATVKFKYKG EEKEVDISKI KKVWRVGKMI SFTYDEGGGK TGRGAVSEKD APKELLQMLE KQKK; wherein $X^1$ is any amino acid other than P; in some embodiments, $X^1$ is selected from Q, N, H, S, T, Y, C, M, W, A, I, L, F, V, G; in some embodiments, $X^1$ is H; and wherein $X^2$ is selected from Q, N, H, S, T, Y, C, M, W, A, I, L, F, V, P, and G; in some embodiments, $X^2$ is selected from Q and N. |
| 148 | P36$X^1$ K762Q K775S variant of Deep Vent DNA polymerase amino acid sequence with sequence non-specific DNA binding domain | MILDADYITE DGKPIIRIFK KENGEFKVEY DRNFRX$^1$YIYA LLKDDSQIDE VRKITAERHG KIVRIIDAEK VRKKFLGRPI EVWRLYFEHP QDVPAIRDKI REHSAVIDIF EYDIPFAKRY LIDKGLIPME GDEELKLLAF DIETLYHEGE EFAKGPIIMI SYADEEEAKV ITWKKIDLPY VEVVSSEREM IKRFLKVIRE KDPDVIITYN GDSFDLPYLV KRAEKLGIKL PLGRDGSEPK |

-continued

Table of Sequences

| SEQ ID NO | Description | Sequence |
|---|---|---|
| | | MQRLGDMTAV EIKGRIHFDL YHVIRRTINL PTYTLEAVYE AIFGKPKEKV YAHEIAEAWE TGKGLERVAK YSMEDAKVTY ELGREFFPME AQLSRLVGQP LWDVSRSSTG NLVEWYLLRK AYERNELAPN KPDEREYERR LRESYAGGYV KEPEKGLWEG LVSLDFRSLY PSIIITHNVS PDTLNREGCR EYDVAPEVGH KFCKDFPGFI PSLLKRLLDE RQEIKRKMKA SKDPIEKKML DYRQRAIKIL ANSYYGYYGY AKARWYCKEC AESVTAWGRE YIEFVRKELE EKFGFKVLYI DTDGLYATIP GAKPEEIKKK ALEFVDYINA KLPGLLELEY EGFYVRGFFV TKKKYALIDE EGKIITRGLE IVRRDWSEIA KETQAKVLEA ILKHGNVEEA VKIVKEVTEK LSKYEIPPEK LVIYEQITRP LHEYKAIGPH VAVAKRLAAR GVKVRPGMVI GYIVLRGDGP ISKRAILAEE FDLRKHKYDA EYYIENQVLP AVLRILEAFG YRKEDLRWQK TQQTGLTAWL NIKKSGTGGG GATVKFKYKG EEKEVDISKI KKVWRVGKMI SFTYDEGGGK TGRGAVSEKD APKELLQMLE KQKK; wherein X$^1$ is any amino acid other than P; in some embodiments, X$^1$ is selected from Q, N, H, S, T, Y, C, M, W, A, I, L, F, V, G; in some embodiments, X$^1$ is H. |
| 149 | P36X$^1$ K764X$^2$ variant of *Thermococcus litoralis* DNA polymerase | MILDTDYITK DGKPIIRIFK KENGEFKIEL DPHFQX$^1$YIYA LLKDDSAIEE IKAIKGERHG KTVRVLDAVK VRKKFLGREV EVWKLIFEHP QDVPAMRGKI REHPAVVDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKEHPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYARNELA PNKPDEEEYK RRLRTTYLGG YVKEPEKGLW ENIIYLDFRS LYPSIIVTHN VSPDTLEKEG CKNYDVAPIV GYRFCKDFPG FIPSILGDLI AMRQDIKKKM KSTIDPIEKK MLDYRQRAIK LLANSYYGYM GYPKARWYSK ECAESVTAWG RHYIEMTIRE IEEKFGFKVL YADTDGFYAT IPGEKPELIK KKAKEFLNYI NSKLPGLLEL EYEGFYLRGF FVTKKRYAVI DEEGRITTRG LEVVRRDWSE IAKETQAKVL EAILKEGSVE KAVEVVRDVV EKIAKYRVPL EKLVIHEQIT RDLKDYKAIG PHVAIAKRLA ARGIKVKPGT IISYIVLKGS GKISDRVILL TEYDPRKHKY DPDYYIENQV LPAVLRILEA FGYRKEDLRY QSSXQTGLDA WLKR; wherein X$^1$ is any amino acid other than P; in some embodiments, X$^1$ is selected from Q, N, H, S, T, Y, C, M, W, A, I, L, F, V, G; in some embodiments, X$^1$ is H; and wherein X$^2$ is selected from Q, N, H, S, T, Y, C, M, W, A, I, L, F, V, P, and G; in some embodiments, X$^2$ is selected from Q and N. |
| 150 | P36X$^1$ K764Q variant of *Thermococcus litoralis* DNA polymerase | MILDTDYITK DGKPIIRIFK KENGEFKIEL DPHFQX$^1$YIYA LLKDDSAIEE IKAIKGERHG KTVRVLDAVK VRKKFLGREV EVWKLIFEHP QDVPAMRGKI REHPAVVDIY EYDIPFAKRY LIDKGLIPME GDEELKLLAF DIETFYHEGD EFGKGEIIMI SYADEEEARV ITWKNIDLPY VDVVSNEREM IKRFVQVVKE KDPDVIITYN GDNFDLPYLI KRAEKLGVRL VLGRDKEHPE PKIQRMGDSF AVEIKGRIHF DLFPVVRRTI NLPTYTLEAV YEAVLGKTKS KLGAEEIAAI WETEESMKKL AQYSMEDARA TYELGKEFFP MEAELAKLIG QSVWDVSRSS TGNLVEWYLL RVAYARNELA PNKPDEEEYK RRLRTTYLGG YVKEPEKGLW ENIIYLDFRS LYPSIIVTHN VSPDTLEKEG CKNYDVAPIV GYRFCKDFPG FIPSILGDLI AMRQDIKKKM KSTIDPIEKK MLDYRQRAIK LLANSYYGYM GYPKARWYSK ECAESVTAWG RHYIEMTIRE IEEKFGFKVL YADTDGFYAT IPGEKPELIK KKAKEFLNYI NSKLPGLLEL EYEGFYLRGF FVTKKRYAVI DEEGRITTRG LEVVRRDWSE IAKETQAKVL EAILKEGSVE KAVEVVRDVV EKIAKYRVPL EKLVIHEQIT RDLKDYKAIG PHVAIAKRLA ARGIKVKPGT IISYIVLKGS GKISDRVILL TEYDPRKHKY DPDYYIENQV LPAVLRILEA FGYRKEDLRY QSSQQTGLDA WLKR; wherein X$^1$ is any amino acid other than P; in some embodiments, X$^1$ is selected from Q, N, H, S, T, Y, C, M, W, A, I, L, F, V, G; in some embodiments, X$^1$ is H. |

Table of Sequences

| SEQ ID NO | Description | Sequence |
|---|---|---|
| 151 | P36X¹ K764X² variant of *Thermococcus litoralis* DNA polymerase, sequence 2 (acc. ADK47977.1) | MILDTDYITK DGKPIIRIFK KENGEFKIEL DPHFQX$^1$YIYA<br>LLKDDSAIEE IKAIKGERHG KSVRVVDAVK VKKKFLGREV<br>EVWKLIFEHP QDVPAMRDKI KEHPAVIDIY EYDIPFAKRY<br>LIDKGLIPME GDEELKLLAF DIETFYHEGD EFGKGEIIMI<br>SYADEEEARV ITWKNIDLPY VDVVSNEREM IKRFVQVVKE<br>KDPDVIITYN GDNFDLPYLI KRAEKLGVRL VLGRDKENPE<br>PKIQRMGDSF AVEIKGRIHF DLFPVVRRTI NLPTYTLEAV<br>YEAVLGKTKS KLGAEEIAAI WETEESMKKL AQYSMEDARA<br>TYELGKEFFP MEAELAKLIG QSVWDVSRSS TGNLVEWYLL<br>RVAYERNELA PNKPDEEEYK RRLRTTYLGG YVKEPEKGLW<br>ENIIYLDFRS LYPSIIVTHN VSPDTLEKEG CENYDIAPIV<br>SYRFCKDFPG FIPSILGDLI AMRQEIKKKM KATIDPVERK<br>MLDYRQRAVK LLANSYYGYM GYPKARWYSK ECAESVTAWG<br>RHYIEMTIKE IEEKFGFKVL YADTDGFYAT ISGEKPEIIK<br>KKAREFLNYI NSKLPGLLEL EYEGFYLRGF FVTKKRYAVI<br>DEEGRITTRG LEVVRRDWSE IAKETQAKVL EAILKDGSVE<br>KAVEIVRDVL EKIAKYRVPL EKLVIHEQIT RDLKDYKAIG<br>PHVAIAKRLA ARGIKVKPGT IISYIVLKGS GKISDRVILL<br>TEYDPEKHKY DPDYYIENQV LPAVLRILEA FGYRKEDLRY<br>QSSXQTGLDA WLKR;<br>wherein X$^1$ is any amino acid other than P; in some embodiments, X$^1$ is selected from Q, N, H, S, T, Y, C, M, W, A, I, L, F, V, G; in some embodiments, X$^1$ is H; and<br>wherein X$^2$ is selected from Q, N, H, S, T, Y, C, M, W, A, I, L, F, V, P, and G; in some embodiments, X$^2$ is selected from Q and N. |
| 152 | P36X¹ K764Q variant of *Thermococcus litoralis* DNA polymerase, sequence 2 (acc. ADK47977.1) | MILDTDYITK DGKPIIRIFK KENGEFKIEL DPHFQX$^1$YIYA<br>LLKDDSAIEE IKAIKGERHG KSVRVVDAVK VKKKFLGREV<br>EVWKLIFEHP QDVPAMRDKI KEHPAVIDIY EYDIPFAKRY<br>LIDKGLIPME GDEELKLLAF DIETFYHEGD EFGKGEIIMI<br>SYADEEEARV ITWKNIDLPY VDVVSNEREM IKRFVQVVKE<br>KDPDVIITYN GDNFDLPYLI KRAEKLGVRL VLGRDKENPE<br>PKIQRMGDSF AVEIKGRIHF DLFPVVRRTI NLPTYTLEAV<br>YEAVLGKTKS KLGAEEIAAI WETEESMKKL AQYSMEDARA<br>TYELGKEFFP MEAELAKLIG QSVWDVSRSS TGNLVEWYLL<br>RVAYERNELA PNKPDEEEYK RRLRTTYLGG YVKEPEKGLW<br>ENIIYLDFRS LYPSIIVTHN VSPDTLEKEG CENYDIAPIV<br>SYRFCKDFPG FIPSILGDLI AMRQEIKKKM KATIDPVERK<br>MLDYRQRAVK LLANSYYGYM GYPKARWYSK ECAESVTAWG<br>RHYIEMTIKE IEEKFGFKVL YADTDGFYAT ISGEKPEIIK<br>KKAREFLNYI NSKLPGLLEL EYEGFYLRGF FVTKKRYAVI<br>DEEGRITTRG LEVVRRDWSE IAKETQAKVL EAILKDGSVE<br>KAVEIVRDVL EKIAKYRVPL EKLVIHEQIT RDLKDYKAIG<br>PHVAIAKRLA ARGIKVKPGT IISYIVLKGS GKISDRVILL<br>TEYDPEKHKY DPDYYIENQV LPAVLRILEA FGYRKEDLRY<br>QSSQQTGLDA WLKR;<br>wherein X$^1$ is any amino acid other than P; in some embodiments, X$^1$ is selected from Q, N, H, S, T, Y, C, M, W, A, I, L, F, V, G; in some embodiments, X$^1$ is H. |
| 153 | P36X¹ R761X² variant of *Thermococcus gorgonarius* DNA polymerase | MILDTDYITE DGKPVIRIFK KENGEFKIDY DRNFEX$^1$YIYA<br>LLKDDSAIED VKKITAERHG TTVRVVRAEK VKKKFLGRPI<br>EVWKLYFTHP QDVPAIRDKI KEHPAVVDIY EYDIPFAKRY<br>LIDKGLIPME GDEELKMLAF DIETLYHEGE EFAEGPILMI<br>SYADEEGARV ITWKNIDLPY VDVVSTEKEM IKRFLKVVKE<br>KDPDVLITYN GDNFDFAYLK KRSEKLGVKF ILGREGSEPK<br>IQRMGDRFAV EVKGRIHFDL YPVIRRTINL PTYTLEAVYE<br>AIFGQPKEKV YAEEIAQAWE TGEGLERVAR YSMEDAKVTY<br>ELGKEFFPME AQLSRLVGQS LWDVSRSSTG NLVEWFLLRK<br>AYERNELAPN KPDERELARR RESYAGGYVK EPERGLWENI<br>VYLDFRSLYP SIIITHNVSP DTLNREGCEE YDVAPQVGHK<br>FCKDFPGFIP SLLGDLLEER QKVKKKMKAT IDPIEKKLLD<br>YRQRAIKILA NSFYGYYGYA KARWYCKECA ESVTAWGRQY<br>IETTIREIEE KFGFKVLYAD TDGFFATIPG ADAETVKKKA<br>KEFLDYINAK LPGLLELEYE GFYKRGFFVT KKKYAVIDEE<br>DKITTRGLEI VRRDWSEIAK ETQARVLEAI LKHGDVEEAV<br>RIVKEVTEKL SKYEVPPEKL VIYEQITRDL KDYKATGPHV<br>AVAKRLAARG IKIRPGTVIS YIVLKGSGRI GDRAIPFDEF<br>DPAKHKYDAE YYIENQVLPA VERILRAFGY RKEDLRYQKT |

Table of Sequences

| SEQ ID NO | Description | Sequence |
|---|---|---|
| | | XQVGLGAWLK PKT;<br>wherein $X^1$ is any amino acid other than P; in some embodiments, $X^1$ is selected from Q, N, H, S, T, Y, C, M, W, A, I, L, F, V, G; in some embodiments, $X^1$ is H; and<br>wherein $X^2$ is selected from Q, N, H, S, T, Y, C, M, W, A, I, L, F, V, P, and G; in some embodiments, $X^2$ is selected from Q and N. |
| 154 | P36$X^1$ R761Q variant of *Thermococcus gorgonarius* DNA polymerase | MILDTDYITE DGKPVIRIFK KENGEFKIDY DRNFEX$^1$YIYA<br>LLKDDSAIED VKKITAERHG TTVRVVRAEK VKKKFLGRPI<br>EVWKLYFTHP QDVPAIRDKI KEHPAVVDIY EYDIPFAKRY<br>LIDKGLIPME GDEELKMLAF DIETLYHEGE EFAEGPILMI<br>SYADEEGARV ITWKNIDLPY VDVVSTEKEM IKRFLKVVKE<br>KDPDVLITYN GDNFDFAYLK KRSEKLGVKF ILGREGSEPK<br>IQRMGDRFAV EVKGRIHFDL YPVIRRTINL PTYTLEAVYE<br>AIFGQPKEKV YAEEIAQAWE TGEGLERVAR YSMEDAKVTY<br>ELGKEFFPME AQLSRLVGQS LWDVSRSSTG NLVEWFLLRK<br>AYERNELAPN KPDERELARR RESYAGGYVK EPERGLWENI<br>VYLDFRSLYP SIIITHNVSP DTLNREGCEE YDVAPQVGHK<br>FCKDFPGFIP SLLGDLLEER QKVKKKMKAT IDPIEKKLLD<br>YRQRAIKILA NSFYGYYGYA KARWYCKECA ESVTAWGRQY<br>IETTIREIEE KFGFKVLYAD TDGFFATIPG ADAETVKKKA<br>KEFLDYINAK LPGLLELEYE GFYKRGFFVT KKKYAVIDEE<br>DKITTRGLEI VRRDWSEIAK ETQARVLEAI LKHGDVEEAV<br>RIVKEVTEKL SKYEVPPEKL VIYEQITRDL KDYKATGPHV<br>AVAKRLAARG IKIRPGTVIS YIVLKGSGRI GDRAIPFDEF<br>DPAKHKYDAE YYIENQVLPA VERILRAFGY RKEDLRYQKT<br>QQVGLGAWLK PKT;<br>wherein $X^1$ is any amino acid other than P; in some embodiments, $X^1$ is selected from Q, N, H, S, T, Y, C, M, W, A, I, L, F, V, G; in some embodiments, $X^1$ is H. |
| 155 | P36$X^1$ R761$X^2$ variant of *Thermococcus kodakarensis* DNA polymerase | MILDTDYITE DGKPVIRIFK KENGEFKIEY DRIFEX$^1$YFYA<br>LLKDDSAIEE VKKITAERHG TVVTVKRVEK VQKKFLGRPV<br>EVWKLYFTHP QDVPAIRDKI REHPAVIDIY EYDIPFAKRY<br>LIDKGLVPME GDEELKMLAF DIETLYHEGE EFAEGPILMI<br>SYADEEGARV ITWKNVDLPY VDVVSTEREM IKRFLRVVKE<br>KDPDVLITYN GDNFDFAYLK KRCEKLGINF ALGRDGSEPK<br>IQRMGDRFAV EVKGRIHFDL YPVIRRTINL PTYTLEAVYE<br>AVFGQPKEKV YAEEITTAWE TGENLERVAR YSMEDAKVTY<br>ELGKEFLPME AQLSRLIGQS LWDVSRSSTG NLVEWFLLRK<br>AYERNELAPN KPDEKELARR RQSYEGGYVK EPERGLWENI<br>VYLDFRSLYP SIIITHNVSP DTLNREGCKE YDVAPQVGHR<br>FCKDFPGFIP SLLGDLLEER QKIKKKMKAT IDPIERKLLD<br>YRQRAIKILA NSYYGYYGYA RARWYCKECA ESVTAWGREY<br>ITMTIKEIEE KYGFKVIYSD TDGFFATIPG ADAETVKKKA<br>MEFLKYINAK LPGALELEYE GFYKRGFFVT KKKYAVIDEE<br>GKITTRGLEI VRRDWSEIAK ETQARVLEAL LKDGDVEKAV<br>RIVKEVTEKL SKYEVPPEKL VIHEQITRDL KDYKATGPHV<br>AVAKRLAARG VKIRPGTVIS YIVLKGSGRI GDRAIPFDEF<br>DPTKHKYDAE YYIENQVLPA VERILRAFGY RKEDLRYQKT<br>XQVGLSAWLK PKGT;<br>wherein $X^1$ is any amino acid other than P; in some embodiments, $X^1$ is selected from Q, N, H, S, T, Y, C, M, W, A, I, L, F, V, G; in some embodiments, $X^1$ is H; and<br>wherein $X^2$ is selected from Q, N, H, S, T, Y, C, M, W, A, I, L, F, V, P, and G; in some embodiments, $X^2$ is selected from Q and N. |
| 156 | P36$X^1$ R761Q variant of *Thermococcus kodakarensis* DNA polymerase | MILDTDYITE DGKPVIRIFK KENGEFKIEY DRIFEX$^1$YFYA<br>LLKDDSAIEE VKKITAERHG TVVTVKRVEK VQKKFLGRPV<br>EVWKLYFTHP QDVPAIRDKI REHPAVIDIY EYDIPFAKRY<br>LIDKGLVPME GDEELKMLAF DIETLYHEGE EFAEGPILMI<br>SYADEEGARV ITWKNVDLPY VDVVSTEREM IKRFLRVVKE<br>KDPDVLITYN GDNFDFAYLK KRCEKLGINF ALGRDGSEPK<br>IQRMGDRFAV EVKGRIHFDL YPVIRRTINL PTYTLEAVYE<br>AVFGQPKEKV YAEEITTAWE TGENLERVAR YSMEDAKVTY<br>ELGKEFLPME AQLSRLIGQS LWDVSRSSTG NLVEWFLLRK<br>AYERNELAPN KPDEKELARR RQSYEGGYVK EPERGLWENI<br>VYLDFRSLYP SIIITHNVSP DTLNREGCKE YDVAPQVGHR |

-continued

Table of Sequences

| SEQ ID NO | Description | Sequence |
|---|---|---|
| | | FCKDFPGFIP SLLGDLLEER QKIKKKMKAT IDPIERKLLD YRQRAIKILA NSYYGYYGYA RARWYCKECA ESVTAWGREY ITMTIKEIEE KYGFKVIYSD TDGFFATIPG ADAETVKKKA MEFLKYINAK LPGALELEYE GFYKRGFFVT KKKYAVIDEE GKITTRGLEI VRRDWSEIAK ETQARVLEAL LKDGDVEKAV RIVKEVTEKL SKYEVPPEKL VIHEQITRDL KDYKATGPHV AVAKRLAARG VKIRPGTVIS YIVLKGSGRI GDRAIPFDEF DPTKHKYDAE YYIENQVLPA VERILRAFGY RKEDLRYQKT QQVGLSAWLK PKGT; wherein $X^1$ is any amino acid other than P; in some embodiments, $X^1$ is selected from Q, N, H, S, T, Y, C, M, W, A, I, L, F, V, G; in some embodiments, $X^1$ is H. |
| 157 | $P36X^1$ $K761X^2$ variant of *Thermococcus species* 9o N-7 DNA polymerase | MILDTDYITE NGKPVIRVFK KENGEFKIEY DRIFEX$^1$YFYA LLKDDSAIED VKKVTAKRHG TVVKVKRAEK VQKKFLGRPI EVWKLYFNHP QDVPAIRDRI RAHPAVVDIY EYDIPFAKRY LIDKGLIPME GDEELTMLAF DIETLYHEGE EFGTGPILMI SYADGSEARV ITWKKIDLPY VDVVSTEKEM IKRFLRVVRE KDPDVLITYN GDNFDFAYLK KRCEELGIKF TLGRDGSEPK IQRMGDRFAV EVKGRIHFDL YPVIRRTINL PTYTLEAVYE AVFGKPKEKV YAEEIAQAWE SGEGLERVAR YSMEDAKVTY ELGREFFPME AQLSRLIGQS LWDVSRSSTG NLVEWFLLRK AYKRNELAPN KPDERELARR RGGYAGGYVK EPERGLWDNI VYLDFRSLYP SIIITHNVSP DTLNREGCKE YDVAPEVGHK FCKDFPGFIP SLLGDLLEER QKIKRKMKAT VDPLEKKLLD YRQRAIKILA NSFYGYYGYA KARWYCKECA ESVTAWGREY IEMVIRELEE KFGFKVLYAD TDGLHATIPG ADAETVKKKA KEFLKYINPK LPGLLELEYE GFYVRGFFVT KKKYAVIDEE GKITTRGLEI VRRDWSEIAK ETQARVLEAI LKHGDVEEAV RIVKEVTEKL SKYEVPPEKL VIHEQITRDL RDYKATGPHV AVAKRLAARG VKIRPGTVIS YIVLKGSGRI GDRAIPADEF DPTKHRYDAE YYIENQVLPA VERILKAFGY RKEDLRYQKT XQVGLGAWLK VKGKK; wherein $X^1$ is any amino acid other than P; in some embodiments, $X^1$ is selected from Q, N, H, S, T, Y, C, M, W, A, I, L, F, V, G; in some embodiments, $X^1$ is H; and wherein $X^2$ is selected from Q, N, H, S, T, Y, C, M, W, A, I, L, F, V, P, and G; in some embodiments, $X^2$ is selected from Q and N. |
| 158 | $P36X^1$ K761Q variant of *Thermococcus species* 9o N-7 DNA polymerase | MILDTDYITE NGKPVIRVFK KENGEFKIEY DRIFEX$^1$YFYA LLKDDSAIED VKKVTAKRHG TVVKVKRAEK VQKKFLGRPI EVWKLYFNHP QDVPAIRDRI RAHPAVVDIY EYDIPFAKRY LIDKGLIPME GDEELTMLAF DIETLYHEGE EFGTGPILMI SYADGSEARV ITWKKIDLPY VDVVSTEKEM IKRFLRVVRE KDPDVLITYN GDNFDFAYLK KRCEELGIKF TLGRDGSEPK IQRMGDRFAV EVKGRIHFDL YPVIRRTINL PTYTLEAVYE AVFGKPKEKV YAEEIAQAWE SGEGLERVAR YSMEDAKVTY ELGREFFPME AQLSRLIGQS LWDVSRSSTG NLVEWFLLRK AYKRNELAPN KPDERELARR RGGYAGGYVK EPERGLWDNI VYLDFRSLYP SIIITHNVSP DTLNREGCKE YDVAPEVGHK FCKDFPGFIP SLLGDLLEER QKIKRKMKAT VDPLEKKLLD YRQRAIKILA NSFYGYYGYA KARWYCKECA ESVTAWGREY IEMVIRELEE KFGFKVLYAD TDGLHATIPG ADAETVKKKA KEFLKYINPK LPGLLELEYE GFYVRGFFVT KKKYAVIDEE GKITTRGLEI VRRDWSEIAK ETQARVLEAI LKHGDVEEAV RIVKEVTEKL SKYEVPPEKL VIHEQITRDL RDYKATGPHV AVAKRLAARG VKIRPGTVIS YIVLKGSGRI GDRAIPADEF DPTKHRYDAE YYIENQVLPA VERILKAFGY RKEDLRYQKT QQVGLGAWLK VKGKK; wherein $X^1$ is any amino acid other than P; in some embodiments, $X^1$ is selected from Q, N, H, S, T, Y, C, M, W, A, I, L, F, V, G; in some embodiments, $X^1$ is H. |
| 159 | $P40X^1$ E775Q variant of *Pyrobaculum calidifontis* DNA polymerase | MRFWPLDATY SVVGGVPEVR VFGVDGEGRR VVLVDRRFRX$^1$ YFYAKCDKCD ASLAKSYLSR VAPVEAVEVV ERRFFGRPTI FLKVVAKVPE DVRKLREAAL GAPGVVDVYE ADIRYYMRYM IDKGVVPCAW NVVEAREAGK LGPLPLYEVV EWAGVEEGFP PPLRVLAFDI EVYNERGSPD PLRDPVVMLA VKTSDGREEV FEAEGRDDRR VIRGFVDFVK EFDPDVIVGY NSNGFDWPYL |

| Table of Sequences | | |
|---|---|---|
| SEQ ID NO | Description | Sequence |
| | | SERAKALGVP LRVDRLGGVP QQSVYGHWSV VGRANVDLYN<br>IVDEFPEIKV KTLDRVAEYF GVMKRSERVL IPGHKVYEYW<br>NDPAKRPTLM RYVLDDVRST LGLAEKLLPF LIQLSSVSGL<br>PLDQVAAASV GNRVEWMLLR YAYRMGEVAP NREEREYEPY<br>KGAIVLEPKP GLYSDVLVLD FSSMYPNIMM KYNLSPDTYL<br>EPHEPDPPEG VVVAPEVGHR FRKAPTGFIP AVLKHLVELR<br>RAVREEAKKY PPDSPEYRLL DERQRALKVM ANAMYGYLGW<br>VGARWYKKEV AESVTAFARA ILLDVVEYAK RLGIEVIYGD<br>TDSLFVKKSG AVDRLVKYVE ERHGIEIKVD KDYERVLFTE<br>AKKRYAGLLR DGRIDIVGFE VVRGDWCELA KEVQLNVVEL<br>ILKSKSVGEA RERVVKYVRE VVERLKAYKF DLDDLIIWKT<br>LDKELDEYKA YGPHVHAALE LKRRGYKVGK GTTVGYVIVR<br>GPGKVSERAM PYIFVDDASK VDVDYYIEKQ VIPAALRIAE<br>VLGVKESDLK TGRVQKSLLD FLG;<br>wherein X$^1$ is any amino acid other than P; in some embodiments, X$^1$ is selected from Q, N, H, S, T, Y, C, M, W, A, I, L, F, V, G; in some embodiments, X$^1$ is H. |
| 160 | P42X$^1$ E778Q variant of *Pyrobaculum aerophilum* DNA polymerase | MKFKLWPLDA TYSVVGGVPE VRIFGISESG DRVVVVDRRF<br>RX$^1$YFYADCPA CDPESVRSQL GRVAPVEEVV AVERRYLGRP<br>RSFLKIVARV PEDVRKLREA AAALPGVSGV YEADIRFYMR<br>YMLDMGVVPC SWNTVDAEAT GEKLGNLPVY KVAEWGGVTE<br>GPPPPLRVLA FDIEVYNERG TPDDPLRDPV I LLAVQASDGR<br>VEVFEASGRD DRSVLRSFID FVREFDPDVI VGYNSNQFDW<br>PYLAERARAL GIPLKVDRVG GAPQQSVYGH WSVTGRANVD<br>LYNIVDEFPE IKLKTLDRVA EYFGVMKREE RVLVPGHKIY<br>EYWRDQGKRP LLRQYVIDDV KSTYGLAEKL LPFLIQLSSV<br>SGLPLDQVAA ASVGNRVEWM LLRYAYRLGE VAPNREEREY<br>EPYKGAIVLE PRPGLYSDVL ALDFSSMYPN IMMKYNLSPD<br>TYLERGEPDP PGGVYVAPEV GHRFRREPPG FIPLVLRQLI<br>ELRKRVREEL KKYPPDSPEY RVLDERQRAL KIMANAMYGY<br>TGWVGARWYK KEVAESVTAF ARAILKDVIE YARKAGIVVI<br>YGDTDSLFVK KSGDVEKLVK YVEEKYGIDI KIDKDYSTVL<br>FTEAKKRYAG LLRDGRIDIV GFEVVRGDWS ELAKEVQLRV<br>IELILTSRDV SEARQKVVKY VRGVIDKLRN YEVDLDDLII<br>WKTLDKELDE YKAYPPHVHA AILLKKRGYK VGKGTTIGYV<br>VVKGGEKVSE RAVPYIFIDD IEKIDLDYYV ERQVIPAALR<br>IAEVIGIKEG DLKTGRSQRT LLDFF;<br>wherein X$^1$ is any amino acid other than P; in some embodiments, X$^1$ is selected from Q, N, H, S, T, Y, C, M, W, A, I, L, F, V, G; in some embodiments, X$^1$ is H. |
| 161 | *Pyrococcus* DNA polymerase sequence including exonuclease domain and catalytic domain, P36X$^1$ | MILDADYITE EGKPVIRLFK KENGEFKIEH DRTFRX$^1$YIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME GDEELKLLAF DIETLYHEGE EFGKGPIIMI<br>SYADEEEAKV ITWKKIDLPY VEVVSSEREM IKRFLKIIRE<br>KDPDIIITYN GDSFDLPYLA KRAEKLGIKL TIGRDGSEPK<br>MQRIGDMTAV EVKGRIHFDL YHVIRRTINL PTYTLEAVYE<br>AIFGKPKEKV YADEIAKAWE TGEGLERVAK YSMEDAKATY<br>ELGKEFFPME AQLSRLVGQP LWDVSRSSTG NLVEWFLLRK<br>AYERNELAPN KPDEREYERR LRESYAGGFV KEPEKGLWEN<br>IVSLDFRALY PSIIITHNVS PDTLNREGCR NYDVAPEVGH<br>KFCKDFPGFI PSLLKRLLDE RQKIKTKMKA SQDPIEKIML<br>DYRQRAIKIL ANSYYGYYGY AKARWYCKEC AESVTAWGRE<br>YIEFVWKELE EKFGFKVLYI DTDGLYATIP GGKSEEIKKK<br>ALEFVDYINA KLPGLLELEY EGFYKRGFFV TKKKYALIDE<br>EGKIITRGLE IVRRDWSEIA KETQARVLEA ILKHGNVEEA<br>VRIVKEVTQK LSKYEIPPEK LAIYEQITRP LHEYKAIGPH<br>VAVAKRLAAK GVKIKPGMVI GYIVLRGDGP ISNRAILAEE<br>YDPRKHKYDA EYYIENQVLP AVLRILEGFG YRKEDLRWQK<br>TKQTGL;<br>wherein X$^1$ is any amino acid other than P; in some embodiments, X$^1$ is selected from Q, N, H, S, T, Y, C, M, W, A, I, L, F, V, G; in some embodiments, X$^1$ is H. |
| 162 | *Pyrococcus* DNA polymerase N-terminal domain comprising a uracil-binding pocket, P36X$^1$ | MILDADYITE EGKPVIRLFK KENGEFKIEH DRTFRX$^1$YIYA<br>LLKDDSKIEE VKKITAERHG KIVRIVDAEK VEKKFLGRPI<br>TVWRLYFEHP QDVPTIREKI REHSAVVDIF EYDIPFAKRY<br>LIDKGLIPME G; |

| Table of Sequences | | |
|---|---|---|
| SEQ ID NO | Description | Sequence |
| | | wherein X¹ is any amino acid other than P; in some embodiments, X¹ is selected from Q, N, H, S, T, Y, C, M, W, A, I, L, F, V, G; in some embodiments, X¹ is H. |
| 163 | Pfu DNA polymerase (GenBank Acc. No. WP_011011325.1) N-terminal domain comprising a uracil-binding pocket, P36X¹ | MILDVDYITE EGKPVIRLFK KENGKFKIEH DRTFRX¹YIYA LLRDDSKIEE VKKITGERHG KIVRIVDVEK VEKKFLGKPI TVWKLYLEHP QDVPTIREKV REHPAVVDIF EYDIPFAKRY LIDKGLIPME G; wherein X¹ is any amino acid other than P; in some embodiments, X¹ is selected from Q, N, H, S, T, Y, C, M, W, A, I, L, F, V, G; in some embodiments, X¹ is H. |
| 164 | Deep Vent DNA polymerase N-terminal domain comprising a uracil-binding pocket, P36X¹ | MILDADYITE DGKPIIRIFK KENGEFKVEY DRNFRX¹YIYA LLKDDSQIDE VRKITAERHG KIVRIIDAEK VRKKFLGRPI EVWRLYFEHP QDVPAIRDKI REHSAVIDIF EYDIPFAKRY LIDKGLIPME G; wherein X¹ is any amino acid other than P; in some embodiments, X¹ is selected from Q, N, H, S, T, Y, C, M, W, A, I, L, F, V, G; in some embodiments, X¹ is H. |
| 165 | *Thermococcus litoralis* DNA polymerase N-terminal domain comprising a uracil-binding pocket, P36X¹ | MILDTDYITK DGKPIIRIFK KENGEFKIEL DPHFQX¹YIYA LLKDDSAIEE IKAIKGERHG KTVRVLDAVK VRKKFLGREV EVWKLIFEHP QDVPAMRGKI REHPAVVDIY EYDIPFAKRY LIDKGLIPME G; wherein X¹ is any amino acid other than P; in some embodiments, X¹ is selected from Q, N, H, S, T, Y, C, M, W, A, I, L, F, V, G; in some embodiments, X¹ is H. |
| 166 | *Thermococcus gorgonarius* DNA polymerase N-terminal domain comprising a uracil-binding pocket, P36X¹ | MILDTDYITE DGKPVIRIFK KENGEFKIDY DRNFEX¹YIYA LLKDDSAIED VKKITAERHG TTVRVVRAEK VKKKFLGRPI EVWKLYFTHP QDVPAIRDKI KEHPAVVDIY EYDIPFAKRY LIDKGLIPME G; wherein X¹ is any amino acid other than P; in some embodiments, X¹ is selected from Q, N, H, S, T, Y, C, M, W, A, I, L, F, V, G; in some embodiments, X¹ is H. |
| 167 | *Thermococcus kodakarensis* DNA polymerase N-terminal domain comprising a uracil-binding pocket, P36X¹ | MILDTDYITE DGKPVIRIFK KENGEFKIEY DRIFEX¹YFYA LLKDDSAIEE VKKITAERHG TVVTVKRVEK VQKKFLGRPV EVWKLYFTHP QDVPAIRDKI REHPAVIDIY EYDIPFAKRY LIDKGLVPME G; wherein X¹ is any amino acid other than P; in some embodiments, X¹ is selected from Q, N, H, S, T, Y, C, M, W, A, I, L, F, V, G; in some embodiments, X¹ is H. |
| 168 | *Thermococcus* species 9o N-7 DNA polymerase N-terminal domain comprising a uracil-binding pocket, P36X¹ | MILDTDYITE NGKPVIRVFK KENGEFKIEY DRIFEX¹YFYA LLKDDSAIED VKKVTAKRHG TVVKVKRAEK VQKKFLGRPI EVWKLYFNHP QDVPAIRDRI RAHPAVVDIY EYDIPFAKRY LIDKGLIPME G; wherein X¹ is any amino acid other than P; in some embodiments, X¹ is selected from Q, N, H, S, T, Y, C, M, W, A, I, L, F, V, G; in some embodiments, X¹ is H. |
| 169 | *Pyrococcus* DNA polymerase sequence including exonuclease domain and DNA binding domain, P36H | MILDADYITE EGKPVIRLFK KENGEFKIEH DRTFRHYIYA LLKDDSKIEE VKKITAERHG KIVRIVDAEK VEKKFLGRPI TVWRLYFEHP QDVPTIREKI REHSAVVDIF EYDIPFAKRY LIDKGLIPME GDEELKLLAF DIETLYHEGE EFGKGPIIMI SYADEEEAKV ITWKKIDLPY VEVVSSEREM IKRFLKIIRE KDPDIIITYN GDSFDLPYLA KRAEKLGIKL TIGRDGSEPK MQRIGDMTAV EVKGRIHFDL YHVIRRTINL PTYTLEAVYE AIFGKPKEKV YADEIAKAWE TGEGLERVAK YSMEDAKATY ELGKEFFPME AQLSRLVGQP LWDVSRSSTG NLVEWFLLRK AYERNELAPN KPDEREYERR LRESYAGGFV KEPEKGLWEN IVSLDFRALY PSIIITHNVS PDTLNREGCR NYDVAPEVGH KFCKDFPGFI PSLLKRLLDE RQKIKTKMKA SQDPIEKIML DYRQRAIKIL ANSYYGYYGY AKARWYCKEC AESVTAWGRE YIEFVWKELE EKFGFKVLYI DTDGLYATIP GGKSEEIKKK |

-continued

Table of Sequences

| SEQ ID NO | Description | Sequence |
|---|---|---|
| | | ALEFVDYINA KLPGLLELEY EGFYKRGFFV TKKKYALIDE EGKIITRGLE IVRRDWSEIA KETQARVLEA ILKHGNVEEA VRIVKEVTQK LSKYEIPPEK LAIYEQITRP LHEYKAIGPH VAVAKRLAAK GVKIKPGMVI GYIVLRGDGP ISNRAILAEE YDPRKHKYDA EYYIENQVLP AVLRILEGFG YRKEDLRWQK TKQTGLTSWL NIKKSGTGGG GATVKFKYKG EEKEVDISKI KKVWRVGKMI SFTYDEGGGK TGRGAVSEKD APKELLQMLE KQKK |

SEQUENCE LISTING (218 sequences)

SEQ ID NO: 1 - protein, 775 aa, Pyrococcus furiosus
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTRQVGLTSWLNIKKS

SEQ ID NO: 2 - protein, 775 aa, Artificial Sequence
  Synthetic polypeptide
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKS

SEQ ID NO: 3 - protein, 775 aa, Artificial Sequence
  Synthetic polypeptide
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKS

SEQ ID NO: 4 - protein, 775 aa, Artificial Sequence
  Synthetic polypeptide
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKS

SEQ ID NO: 5 - protein, 775 aa, Artificial Sequence
  Synthetic polypeptide
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKS

SEQ ID NO: 6 - protein, 383 aa, Pyrococcus furiosus
SYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTRQVGL

SEQ ID NO: 7 - protein, 383 aa, Artificial Sequence
  Synthetic polypeptide
  MISC_FEATURE (379)..(379): X is selected from Q, N, H, S, T, Y, C, M, W, A, I, L, F, V, P, and G
SYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGL

SEQ ID NO: 8 - protein, 383 aa, Artificial Sequence
  Synthetic polypeptide
  MISC_FEATURE (379)..(379): X is selected from Q, N, H, S, T, Y, C, M, W, A, I, L, F, V, P, and G
SYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGL

SEQ ID NO: 9 - protein, 383 aa, Artificial Sequence
  Synthetic polypeptide
SYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGL

SEQ ID NO: 10 - protein, 383 aa, Artificial Sequence
  Synthetic polypeptide
SYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGL

SEQ ID NO: 11 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKSGTGGGGATVKFKYKGEEKEVDISKIKKVWRVGKMISFTYDEGGGKTGRGAVSEKDAPKELLQMLEKQKK

SEQ ID NO: 12 - protein, 844 aa, Artificial Sequence
  Synthetic polypeptide
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKSGTGGGGATVKFKYKGEEKEVDISKIKKVWRVGKMISFTYDEGGGKTGRGAVSEKDAPKELLQMLEKQKK

SEQ ID NO: 13 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKSGTGGGGATVKFKYKGEEKEVDISKIKKVWRVGKMISFTYDEGGGKTGRGAVSEKDAPKELLQMLEKQKK

SEQ ID NO: 14 - protein, 844 aa, Artificial Sequence
  Synthetic polypeptide
MILDVDYITEEGKPVIRLFKKENGKFKIEHDRTFRPYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKSGTGGGGATVKFKYKGEEKEVDISKIKKVWRVGKMISFTYDEGGGKTGRGAVSEKDAPKELLQMLEKQKK

SEQ ID NO: 15 - protein, 383 aa, Artificial Sequence
  Synthetic polypeptide
  MISC_FEATURE (379)..(379): X is selected from Q, N, H, S, T, Y, C, M, W, A, I, L, F, V, P, and G
SYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGL

SEQ ID NO: 16 - protein, 383 aa, Artificial Sequence
  Synthetic polypeptide
  MISC_FEATURE (379)..(379): X is selected from Q, N, H, S, T, Y, C, M, W, A, I, L, F, V, P, and G
SYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGL

SEQ ID NO: 17 - protein, 383 aa, Artificial Sequence
  Synthetic polypeptide
SYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGL

SEQ ID NO: 18 - protein, 383 aa, Artificial Sequence
  Synthetic polypeptide
SYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGL

SEQ ID NO: 19 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDADYITEEGKPVIRLFKKENGEFKIEHDRTFRPYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGLTSWLNIKKSGTGGGGATVKFKYKGEEKEVDISKIKKVWRVGKMISFTYDEGGGKTGRGAVSEKDAPKELLQMLEKQKK

SEQ ID NO: 20 - protein, 844 aa, Artificial Sequence
  Synthetic polypeptide
MILDADYITEEGKPVIRLFKKENGEFKIEHDRTFRPYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGLTSWLNIKKSGTGGGGATVKFKYKGEEKEVDISKIKKVWRVGKMISFTYDEGGGKTGRGAVSEKDAPKELLQMLEKQKK

SEQ ID NO: 21 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDADYITEEGKPVIRLFKKENGEFKIEHDRTFRPYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGLTSWLNIKKSGTGGGGATVKFKYKGEEKEVDISKIKKVWRVGKMISFTYDEGGGKTGRGAVSEKDAPKELLQMLEKQKK

SEQ ID NO: 22 - protein, 844 aa, Artificial Sequence
  Synthetic polypeptide
MILDADYITEEGKPVIRLFKKENGEFKIEHDRTFRPYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGLTSWLNIKKSGTGGGGATVKFKYKGEEKEVDISKIKKVWRVGKMISFTYDEGGGKTGRGAVSEKDAPKELLQMLEKQKK

SEQ ID NO: 23 - protein, 775 aa, Artificial Sequence
  Synthetic polypeptide
  MISC_FEATURE (762)..(762): X is selected from Q, N, H, S, T, Y, C, M, W, A, I, L, F, V, P, and G
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKK

SEQ ID NO: 24 - protein, 775 aa, Artificial Sequence
  Synthetic polypeptide
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKK

SEQ ID NO: 25 - protein, 383 aa, Artificial Sequence
  Synthetic polypeptide
  MISC_FEATURE (379)..(379): X is selected from Q, N, H, S, T, Y, C, M, W, A, I, L, F, V, P, and G
SYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGL

SEQ ID NO: 26 - protein, 383 aa, Artificial Sequence
  Synthetic polypeptide
SYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGL

SEQ ID NO: 27 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKKGTGGGGATVKFKYKGEEKEVDISKIKKVWRVGKMISFTYDEGGGKTGRGAVSEKDAPKELLQMLEKQKK

SEQ ID NO: 28 - protein, 844 aa, Artificial Sequence
  Synthetic polypeptide
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKKGTGGGGATVKFKYKGEEKEVDISKIKKVWRVGKMISFTYDEGGGKTGRGAVSEKDAPKELLQMLEKQKK

SEQ ID NO: 29 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKSGTGGGGATVKFKYKGEEKEVDISKIKKVWRVGKMISFTYDEGGGKTGRGAVSEKDAPKELLQMLEKQKK

SEQ ID NO: 30 - protein, 844 aa, Artificial Sequence
  Synthetic polypeptide
MILDADYITEDGKPIIRIFKKENGEFKVEYDRNFRPYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKSGTGGGGATVKFKYKGEEKEVDISKIKKVWRVGKMISFTYDEGGGKTGRGAVSEKDAPKELLQMLEKQKK

SEQ ID NO: 31 - protein, 774 aa, Artificial Sequence
  Synthetic polypeptide
  MISC_FEATURE (764)..(764): X is selected from Q, N, H, S, T, Y, C, M, W, A, I, L, F, V, P, and G
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSYYGYMGYPKARWYSKECAESVTAWGRHYIEMTIREIEEKFGFKVLYADTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSXQTGLDAWLKR

SEQ ID NO: 32 - protein, 774 aa, Artificial Sequence
  Synthetic polypeptide
MILDTDYITKDGKPIIRIFKKENGEFKIELDPHFQPYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSYYGYMGYPKARWYSKECAESVTAWGRHYIEMTIREIEEKFGFKVLYADTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSQQTGLDAWLKR

SEQ ID NO: 33 - protein, 383 aa, Artificial Sequence
  Synthetic polypeptide
  MISC_FEATURE (379)..(379): X is selected from Q, N, H, S, T, Y, C, M, W, A, I, L, F, V, P, and G
TYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSYYGYMGYPKARWYSKECAESVTAWGRHYIEMTIREIEEKFGFKVLYADTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSXQTGL

SEQ ID NO: 34 - protein, 383 aa, Artificial Sequence
  Synthetic polypeptide
TYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSYYGYMGYPKARWYSKECAESVTAWGRHYIEMTIREIEEKFGFKVLYADTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSQQTGL

SEQ ID NO: 35 - protein, 774 aa, Artificial Sequence
  Synthetic polypeptide
  MISC_FEATURE (764)..(764): X is selected from Q, N, H, S, T, Y, C, M, W, A, I, L, F, V, P, and G
MILDTDYITKDGKPIIRIFKKENGEFKIELDPHFQPYIYALLKDDSAIEEIKAIKGERHGKSVRVVDAVKVKKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPVERKMLDYRQRAVKLLANSYYGYMGYPKARWYSKECAESVTAWGRHYIEMTIKEIEEKFGFKVLYADTDGFYATISGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVLEKIAKYRVPLEKLVIHEQITRDLKDYKAIGPHVAIAKRLAARGIKVKPGTIISYIVLKGSGKISDRVILLTEYDPEKHKYDPDYYIENQVLPAVLRILEAFGYRKEDLRYQSSXQTGLDAWLKR

SEQ ID NO: 36 - protein, 774 aa, Artificial Sequence
  Synthetic polypeptide
MILDTDYITKDGKPIIRIFKKENGEFKIELDPHFQPYIYALLKDDSAIEEIKAIKGERHGKSVRVVDAVKVKKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPVERKMLDYRQRAVKLLANSYYGYMGYPKARWYSKECAESVTAWGRHYIEMTIKEIEEKFGFKVLYADTDGFYATISGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVLEKIAKYRVPLEKLVIHEQITRDLKDYKAIGPHVAIAKRLAARGIKVKPGTIISYIVLKGSGKISDRVILLTEYDPEKHKYDPDYYIENQVLPAVLRILEAFGYRKEDLRYQSSQQTGLDAWLKR

SEQ ID NO: 37 - protein, 383 aa, Artificial Sequence
  Synthetic polypeptide
  MISC_FEATURE (379)..(379): X is selected from Q, N, H, S, T, Y, C, M, W, A, I, L, F, V, P, and G
TYLGGYVKEPEKGLWENIIYLDFRSLYPSIIVTHNVSPDTLEKEGCENYDIAPIVSYRFCKDFPGFIPSILGDLIAMRQEIKKKMKATIDPVERKMLDYRQRAVKLLANSYYGYMGYPKARWYSKECAESVTAWGRHYIEMTIKEIEEKFGFKVLYADTDGFYATISGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVLEKIAKYRVPLEKLVIHEQITRDLKDYKAIGPHVAIAKRLAARGIKVKPGTIISYIVLKGSGKISDRVILLTEYDPEKHKYDPDYYIENQVLPAVLRILEAFGYRKEDLRYQSSXQTGL

SEQ ID NO: 38 - protein, 383 aa, Artificial Sequence
  Synthetic polypeptide
TYLGGYVKEPEKGLWENIIYLDFRSLYPSIIVTHNVSPDTLEKEGCENYDIAPIVSYRFCKDFPGFIPSILGDLIAMRQEIKKKMKATIDPVERKMLDYRQRAVKLLANSYYGYMGYPKARWYSKECAESVTAWGRHYIEMTIKEIEEKFGFKVLYADTDGFYATISGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVLEKIAKYRVPLEKLVIHEQITRDLKDYKAIGPHVAIAKRLAARGIKVKPGTIISYIVLKGSGKISDRVILLTEYDPEKHKYDPDYYIENQVLPAVLRILEAFGYRKEDLRYQSSQQTGL

SEQ ID NO: 39 - protein, 773 aa, Artificial Sequence
  Synthetic polypeptide
  VARIANT (761)..(761): /replace="Asn" or "His" or "Ser" or "Thr" or "Tyr" or "Cys" or "Met" or "Trp" or "Ala" or "Ile" or "Leu" or "Phe" or "Val" or "Pro" or "Gly"
MILDTDYITEDGKPVIRIFKKENGEFKIDYDRNFEPYIYALLKDDSAIEDVKKITAERHGTTVRVVRAEKVKKKFLGRPIEVWKLYFTHPQDVPAIRDKIKEHPAVVDIYEYDIPFAKRYLIDKGLIPMEGDEELKMLAFDIETLYHEGEEFAEGPILMISYADEEGARVITWKNIDLPYVDVVSTEKEMIKRFLKVVKEKDPDVLITYNGDNFDFAYLKKRSEKLGVKFILGREGSEPKIQRMGDRFAVEVKGRIHFDLYPVIRRTINLPTYTLEAVYEAIFGQPKEKVYAEEIAQAWETGEGLERVARYSMEDAKVTYELGKEFFPMEAQLSRLVGQSLWDVSRSSTGNLVEWFLLRKAYERNELAPNKPDERELARRRESYAGGYVKEPERGLWENIVYLDFRSLYPSIIITHNVSPDTLNREGCEEYDVAPQVGHKFCKDFPGFIPSLLGDLLEERQKVKKKMKATIDPIEKKLLDYRQRAIKILANSFYGYYGYAKARWYCKECAESVTAWGRQYIETTIREIEEKFGFKVLYADTDGFFATIPGADAETVKKKAKEFLDYINAKLPGLLELEYEGFYKRGFFVTKKKYAVIDEEDKITTRGLEIVRRDWSEIAKETQARVLEAILKHGDVEEAVRIVKEVTEKLSKYEVPPEKLVIYEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTXQVGLGAWLKPKT

SEQ ID NO: 40 - protein, 773 aa, Artificial Sequence
  Synthetic polypeptide
MILDTDYITEDGKPVIRIFKKENGEFKIDYDRNFEPYIYALLKDDSAIEDVKKITAERHGTTVRVVRAEKVKKKFLGRPIEVWKLYFTHPQDVPAIRDKIKEHPAVVDIYEYDIPFAKRYLIDKGLIPMEGDEELKMLAFDIETLYHEGEEFAEGPILMISYADEEGARVITWKNIDLPYVDVVSTEKEMIKRFLKVVKEKDPDVLITYNGDNFDFAYLKKRSEKLGVKFILGREGSEPKIQRMGDRFAVEVKGRIHFDLYPVIRRTINLPTYTLEAVYEAIFGQPKEKVYAEEIAQAWETGEGLERVARYSMEDAKVTYELGKEFFPMEAQLSRLVGQSLWDVSRSSTGNLVEWFLLRKAYERNELAPNKPDERELARRRESYAGGYVKEPERGLWENIVYLDFRSLYPSIIITHNVSPDTLNREGCEEYDVAPQVGHKFCKDFPGFIPSLLGDLLEERQKVKKKMKATIDPIEKKLLDYRQRAIKILANSFYGYYGYAKARWYCKECAESVTAWGRQYIETTIREIEEKFGFKVLYADTDGFFATIPGADAETVKKKAKEFLDYINAKLPGLLELEYEGFYKRGFFVTKKKYAVIDEEDKITTRGLEIVRRDWSEIAKETQARVLEAILKHGDVEEAVRIVKEVTEKLSKYEVPPEKLVIYEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTQQVGLGAWLKPKT

SEQ ID NO: 41 - protein, 383 aa, Artificial Sequence
  Synthetic polypeptide
  MISC_FEATURE (379)..(379): X is selected from Q, N, H, S, T, Y, C, M, W, A, I, L, F, V, P, and G
SYAGGYVKEPERGLWENIVYLDFRSLYPSIIITHNVSPDTLNREGCEEYDVAPQVGHKFCKDFPGFIPSLLGDLLEERQKVKKKMKATIDPIEKKLLDYRQRAIKILANSFYGYYGYAKARWYCKECAESVTAWGRQYIETTIREIEEKFGFKVLYADTDGFFATIPGADAETVKKKAKEFLDYINAKLPGLLELEYEGFYKRGFFVTKKKYAVIDEEDKITTRGLEIVRRDWSEIAKETQARVLEAILKHGDVEEAVRIVKEVTEKLSKYEVPPEKLVIYEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTXQVGL

SEQ ID NO: 42 - protein, 383 aa, Artificial Sequence
  Synthetic polypeptide
SYAGGYVKEPERGLWENIVYLDFRSLYPSIIITHNVSPDTLNREGCEEYDVAPQVGHKFCKDFPGFIPSLLGDLLEERQKVKKKMKATIDPIEKKLLDYRQRAIKILANSFYGYYGYAKARWYCKECAESVTAWGRQYIETTIREIEEKFGFKVLYADTDGFFATIPGADAETVKKKAKEFLDYINAKLPGLLELEYEGFYKRGFFVTKKKYAVIDEEDKITTRGLEIVRRDWSEIAKETQARVLEAILKHGDVEEAVRIVKEVTEKLSKYEVPPEKLVIYEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTQQVGL

SEQ ID NO: 43 - protein, 774 aa, Artificial Sequence
  Synthetic polypeptide
  MISC_FEATURE (761)..(761): X is selected from Q, N, H, S, T, Y, C, M, W, A, I, L, F, V, P, and G
MILDTDYITEDGKPVIRIFKKENGEFKIEYDRTFEPYFYALLKDDSAIEEVKKITAERHGTVVTVKRVEKVQKKFLGRPVEVWKLYFTHPQDVPAIRDKIREHPAVIDIYEYDIPFAKRYLIDKGLVPMEGDEELKMLAFDIETLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITTAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFRSLYPSIIITHNVSPDTLNREGCKEYDVAPQVGHRFCKDFPGFIPSLLGDLLEERQKIKKKMKATIDPIERKLLDYRQRAIKILANSYYGYYGYARARWYCKECAESVTAWGREYITMTIKEIEEKYGFKVIYSDTDGFFATIPGADAETVKKKAMEFLKYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTXQVGLSAWLKPKGT

SEQ ID NO: 44 - protein, 774 aa, Artificial Sequence
  Synthetic polypeptide
MILDTDYITEDGKPVIRIFKKENGEFKIEYDRTFEPYFYALLKDDSAIEEVKKITAERHGTVVTVKRVEKVQKKFLGRPVEVWKLYFTHPQDVPAIRDKIREHPAVIDIYEYDIPFAKRYLIDKGLVPMEGDEELKMLAFDIETLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITTAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFRSLYPSIIITHNVSPDTLNREGCKEYDVAPQVGHRFCKDFPGFIPSLLGDLLEERQKIKKKMKATIDPIERKLLDYRQRAIKILANSYYGYYGYARARWYCKECAESVTAWGREYITMTIKEIEEKYGFKVIYSDTDGFFATIPGADAETVKKKAMEFLKYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTQQVGLSAWLKPKGT

SEQ ID NO: 45 - protein, 383 aa, Artificial Sequence
  Synthetic polypeptide
  MISC_FEATURE (379)..(379): X is selected from Q, N, H, S, T, Y, C, M, W, A, I, L, F, V, P, and G
SYEGGYVKEPERGLWENIVYLDFRSLYPSIIITHNVSPDTLNREGCKEYDVAPQVGHRFCKDFPGFIPSLLGDLLEERQKIKKKMKATIDPIERKLLDYRQRAIKILANSYYGYYGYARARWYCKECAESVTAWGREYITMTIKEIEEKYGFKVIYSDTDGFFATIPGADAETVKKKAMEFLKYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTXQVGL

SEQ ID NO: 46 - protein, 383 aa, Artificial Sequence
  Synthetic polypeptide
SYEGGYVKEPERGLWENIVYLDFRSLYPSIIITHNVSPDTLNREGCKEYDVAPQVGHRFCKDFPGFIPSLLGDLLEERQKIKKKMKATIDPIERKLLDYRQRAIKILANSYYGYYGYARARWYCKECAESVTAWGREYITMTIKEIEEKYGFKVIYSDTDGFFATIPGADAETVKKKAMEFLKYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTQQVGL

SEQ ID NO: 47 - protein, 383 aa, Artificial Sequence
  Synthetic polypeptide
  MISC_FEATURE (379)..(379): X is selected from Q, N, H, S, T, Y, C, M, W, A, I, L, F, V, P, and G
GYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTQQVGL

SEQ ID NO: 48 - protein, 383 aa, Artificial Sequence; identical to SEQ ID NO: 47
  Synthetic polypeptide

SEQ ID NO: 49 - protein, 775 aa, Artificial Sequence
  Synthetic polypeptide
  MISC_FEATURE (761)..(761): X is selected from Q, N, H, S, T, Y, C, M, W, A, I, L, F, V, P, and G
MILDTDYITENGKPVIRVFKKENGEFKIEYDRTFEPYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTQQVGLGAWLKVKGKK

SEQ ID NO: 50 - protein, 775 aa, Artificial Sequence; identical to SEQ ID NO: 49
  Synthetic polypeptide

SEQ ID NO: 51 - protein, 783 aa, Artificial Sequence
  Synthetic polypeptide
MRFWPLDATYSVVGGVPEVRVFGVDGEGRRVVLVDRRFRPYFYAKCDKCDASLAKSYLSRVAPVEAVEVVERRFFGRPTIFLKVVAKVPEDVRKLREAALGAPGVVDVYEADIRYYMRYMIDKGVVPCAWNVVEAREAGKLGPLPLYEVVEWAGVEEGFPPPLRVLAFDIEVYNERGSPDPLRDPVVMLAVKTSDGREEVFEAEGRDDRRVIRGFVDFVKEFDPDVIVGYNSNGFDWPYLSERAKALGVPLRVDRLGGVPQQSVYGHWSVVGRANVDLYNIVDEFPEIKVKTLDRVAEYFGVMKRSERVLIPGHKVYEYWNDPAKRPTLMRYVLDDVRSTLGLAEKLLPFLIQLSSVSGLPLDQVAAASVGNRVEWMLLRYAYRMGEVAPNREEREYEPYKGAIVLEPKPGLYSDVLVLDFSSMYPNIMMKYNLSPDTYLEPHEPDPPEGVVVAPEVGHRFRKAPTGFIPAVLKHLVELRRAVREEAKKYPPDSPEYRLLDERQRALKVMANAMYGYLGWVGARWYKKEVAESVTAFARAILLDVVEYAKRLGIEVIYGDTDSLFVKKSGAVDRLVKYVEERHGIEIKVDKDYERVLFTEAKKRYAGLLRDGRIDIVGFEVVRGDWCELAKEVQLNVVELILKSKSVGEARERVVKYVREVVERLKAYKFDLDDLIIWKTLDKELDEYKAYGPHVHAALELKRRGYKVGKGTTVGYVIVRGPGKVSERAMPYIFVDDASKVDVDYYIEKQVIPAALRIAEVLGVKESDLKTGRVQKSLLDFLG

SEQ ID NO: 52 - protein, 785 aa, Artificial Sequence
  Synthetic polypeptide
MKFKLWPLDATYSVVGGVPEVRIFGISESGDRVVVVDRRFRPYFYADCPACDPESVRSQLGRVAPVEEVVAVERRYLGRPRSFLKIVARVPEDVRKLREAAAALPGVSGVYEADIRFYMRYMLDMGVVPCSWNTVDAEATGEKLGNLPVYKVAEWGGVTEGFPPPLRVLAFDIEVYNERGTPDPLRDPVILLAVQASDGRVEVFEASGRDDRSVLRSFIDFVREFDPDVIVGYNSNQFDWPYLAERARALGIPLKVDRVGGAPQQSVYGHWSVTGRANVDLYNIVDEFPEIKLKTLDRVAEYFGVMKREERVLVPGHKIYEYWRDQGKRPLLRQYVIDDVKSTYGLAEKLLPFLIQLSSVSGLPLDQVAAASVGNRVEWMLLRYAYRLGEVAPNREEREYEPYKGAIVLEPRPGLYSDVLALDFSSMYPNIMMKYNLSPDTYLERGEPDPPGGVYVAPEVGHRFRREPPGFIPLVLRQLIELRKRVREELKKYPPDSPEYRVLDERQRALKIMANAMYGYTGWVGARWYKKEVAESVTAFARAILKDVIEYARKAGIVVIYGDTDSLFVKKSGDVEKLVKYVEEKYGIDIKIDKDYSTVLFTEAKKRYAGLLRDGRIDIVGFEVVRGDWSELAKEVQLRVIELILTSRDVSEARQKVVKYVRGVIDKLRNYEVDLDDLIIWKTLDKELDEYKAYPPHVHAAILLKKRGYKVGKGTTIGYVVVKGGEKVSERAVPYIFIDDIEKIDLDYYVERQVIPAALRIAEVIGIKEGDLKTGRSQRTLLDFF

SEQ ID NO: 53 - protein, 63 aa, Sulfolobus solfataricus
ATVKFKYKGEEKEVDISKIKKVWRVGKMISFTYDEGGGKTGRGAVSEKDAPKELLQMLEKQKK

SEQ ID NO: 54 - protein, 65 aa, Sulfolobus acidocaldarius
VKVKFKYKGEEKEVDTSKIKKVWRVGKMVSFTYDDNGKTGRGAVSEKDAPKELLDMLARAEREKK

SEQ ID NO: 55 - protein, 56 aa, Pyrobaculum aerophilum
SKKQKLKFYDIKAKQAFETDQYEVIEKQTARGPMMFAVAKSPYTGIKVYRLLGKKK

SEQ ID NO: 56 - protein, 55 aa, Pyrobaculum aerophilum
AKQKLKFYDIKAKQSFETDKYEVIEKETARGPMLFAVATSPYTGIKVYRLLGKKK

SEQ ID NO: 57 - protein, 55 aa, Aeropyrum pernix
PKKEKIKFFDLVAKKYYETDNYEVEIKETKRGKFRFAKAKSPYTGKIFYRVLGKA

SEQ ID NO: 58 - protein, 59 aa, Methanothermus fervidus
GELPIAPIGRIIKNAGAERVSDDARIALAKVLEEMGEEIASEAVKLAKHAGRKTIKAED

SEQ ID NO: 59 - protein, 59 aa, Methanothermus fervidus
ELPIAPIGRIIKDAGAERVSDDARITLAKILEEMGRDIASEAIKLARHAGRKTIKAEDI

SEQ ID NO: 60 - protein, 59 aa, Pyrococcus sp.
GELPIAPVDRLIRKAGAERVSEEAAKILAEYLEEYAIEVSKKAVEFARHAGRKTVKAED

SEQ ID NO: 61 - protein, 59 aa, Pyrococcus sp.
AELPIAPVDRLIRKAGAQRVSEQAAKLLAEHLEEKALEIARKAVDLAKHAGRKTVKAED

SEQ ID NO: 62 - protein, 62 aa, Sulfolobus solfataricus
ATVKFKYKGEEKEVDISKIKKVWRVGKMISFTYDEGGGKTGRGAVSEKDAPKELLQMLEKQK

SEQ ID NO: 63 - protein, 194 aa, Artificial Sequence
  Synthetic polypeptide
EELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEF

SEQ ID NO: 64 - DNA, 20 bp, Artificial Sequence
  Synthetic primer
gaagagccaaggacaggtac

SEQ ID NO: 65 - DNA, 20 bp, Artificial Sequence
  Synthetic primer
cctccaaatcaagcctctac

SEQ ID NO: 66 - DNA, 22 bp, Artificial Sequence
  Synthetic primer
cagtgcagtgcttgataacagg

SEQ ID NO: 67 - DNA, 20 bp, Artificial Sequence
  Synthetic primer
gtagtgcgcgtttgatttcc

SEQ ID NO: 68 - DNA, 20 bp, Artificial Sequence
  Synthetic primer
cctgctctgccgcttcacgc

SEQ ID NO: 69 - DNA, 23 bp, Artificial Sequence
  Synthetic primer
cgaacgtcgcgcagagaaacagg

SEQ ID NO: 70 - DNA, 34 bp, Artificial Sequence
  Synthetic primer
ctgatgagttcgtgtccgtacaactggcgtaatc

SEQ ID NO: 71 - DNA, 34 bp, Artificial Sequence
  Synthetic primer
gtgcaccatgcaacatgaataacagtgggttatc

SEQ ID NO: 72 - DNA, 20 bp, Artificial Sequence
  Synthetic primer
gggcgttttccgtaacactg

SEQ ID NO: 73 - DNA, 20 bp, Artificial Sequence
  Synthetic primer
tgaccacatacaatcgccgt

SEQ ID NO: 74 - DNA, 29 bp, Artificial Sequence
  Synthetic primer
ctccacagggtgaggtctaagtgatgaca

SEQ ID NO: 75 - DNA, 29 bp, Artificial Sequence
  Synthetic primer
caatctcagggcaagttaagggaatagtg

SEQ ID NO: 76 - protein, 766 aa, Artificial Sequence
  Synthetic polypeptide
  MISC_FEATURE (762)..(762): X is selected from Q, N, H, S, T, Y, C, M, W, A, I, L, F, V, P, and G
MILDADYITEEGKPVIRLFKKENGEFKIEHDRTFRPYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGL

SEQ ID NO: 77 - protein, 766 aa, Artificial Sequence
  Synthetic polypeptide
  MISC_FEATURE (762)..(762): X is selected from Q, N, H, S, T, Y, C, M, W, A, I, L, F, V, P, and G
MILDADYITEEGKPVIRLFKKENGEFKIEHDRTFRPYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGL

SEQ ID NO: 78 - protein, 766 aa, Artificial Sequence
  Synthetic polypeptide
MILDADYITEEGKPVIRLFKKENGEFKIEHDRTFRPYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGL

SEQ ID NO: 79 - protein, 766 aa, Artificial Sequence
  Synthetic polypeptide
MILDADYITEEGKPVIRLFKKENGEFKIEHDRTFRPYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGL

SEQ ID NO: 80 - protein, 775 aa, Artificial Sequence
  Synthetic polypeptide
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRHYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKS

SEQ ID NO: 81 - protein, 775 aa, Artificial Sequence
  Synthetic polypeptide
MILDVDYITEEGKPVIRLFKKENGKFKIEHDRTFRHYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKS

SEQ ID NO: 82 - protein, 775 aa, Artificial Sequence
  Synthetic polypeptide
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRHYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKS

SEQ ID NO: 83 - protein, 775 aa, Artificial Sequence
  Synthetic polypeptide
MILDVDYITEEGKPVIRLFKKENGKFKIEHDRTFRHYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKS

SEQ ID NO: 84 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRHYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKSGTGGGGATVKFKYKGEEKEVDISKIKKVWRVGKMISFTYDEGGGKTGRGAVSEKDAPKELLQMLEKQKK

SEQ ID NO: 85 - protein, 844 aa, Artificial Sequence; identical to SEQ ID NO: 84
  Synthetici polypeptide

SEQ ID NO: 86 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRHYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKSGTGGGGATVKFKYKGEEKEVDISKIKKVWRVGKMISFTYDEGGGKTGRGAVSEKDAPKELLQMLEKQKK

SEQ ID NO: 87 - protein, 844 aa, Artificial Sequence
  Synthetic polypeptide
MILDVDYITEEGKPVIRLFKKENGKFKIEHDRTFRHYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKSGTGGGGATVKFKYKGEEKEVDISKIKKVWRVGKMISFTYDEGGGKTGRGAVSEKDAPKELLQMLEKQKK

SEQ ID NO: 88 - protein, 766 aa, Artificial Sequence
  Synthetic polypeptide
  MISC_FEATURE (762)..(762): X is selected from Q, N, H, S, T, Y, C, M, W, A, I, L, F, V, P, and G
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGL

SEQ ID NO: 89 - protein, 766 aa, Artificial Sequence
  Synthetic polypeptide
  MISC_FEATURE (762)..(762): X is selected from Q, N, H, S, T, Y, C, M, W, A, I, L, F, V, P, and G
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGL

SEQ ID NO: 90 - protein, 766 aa, Artificial Sequence
  Synthetic polypeptide
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGL

SEQ ID NO: 91 - protein, 766 aa, Artificial Sequence
  Synthetic polypeptide
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGL

SEQ ID NO: 92 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGLTSWLNIKKSGTGGGGATVKFKYKGEEKEVDISKIKKVWRVGKMISFTYDEGGGKTGRGAVSEKDAPKELLQMLEKQKK

SEQ ID NO: 93 - protein, 844 aa, Artificial Sequence; identical to SEQ ID NO: 92
  Synthetic polypeptide

SEQ ID NO: 94 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGLTSWLNIKKSGTGGGGATVKFKYKGEEKEVDISKIKKVWRVGKMISFTYDEGGGKTGRGAVSEKDAPKELLQMLEKQKK

SEQ ID NO: 95 - protein, 844 aa, Artificial Sequence
  Synthetic polypeptide
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGLTSWLNIKKSGTGGGGATVKFKYKGEEKEVDISKIKKVWRVGKMISFTYDEGGGKTGRGAVSEKDAPKELLQMLEKQKK

SEQ ID NO: 96 - protein, 775 aa, Artificial Sequence
  Synthetic polypeptide
  MISC_FEATURE (762)..(762): X is selected from Q, N, H, S, T, Y, C, M, W, A, I, L, F, V, P, and G
MILDADYITEDGKPIIRIFKKENGEFKVEYDRNFRHYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKK

SEQ ID NO: 97 - protein, 775 aa, Pyrococcus sp.
MILDADYITEDGKPIIRIFKKENGEFKVEYDRNFRHYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKK

SEQ ID NO: 98 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDADYITEDGKPIIRIFKKENGEFKVEYDRNFRHYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKKGTGGGGATVKFKYKGEEKEVDISKIKKVWRVGKMISFTYDEGGGKTGRGAVSEKDAPKELLQMLEKQKK

SEQ ID NO: 99 - protein, 844 aa, Artificial Sequence
  Synthetic polypeptide
MILDADYITEDGKPIIRIFKKENGEFKVEYDRNFRHYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKKGTGGGGATVKFKYKGEEKEVDISKIKKVWRVGKMISFTYDEGGGKTGRGAVSEKDAPKELLQMLEKQKK

SEQ ID NO: 100 - protein, 844 aa, Artificial Sequence
  Synthetic polypeptide
  MISC_FEATURE (762)..(762): X is selected from Q, N, H, S, T, Y, C, M, W, A, I, L, F, V, P, and G
MILDADYITEDGKPIIRIFKKENGEFKVEYDRNFRHYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKSGTGGGGATVKFKYKGEEKEVDISKIKKVWRVGKMISFTYDEGGGKTGRGAVSEKDAPKELLQMLEKQKK

SEQ ID NO: 101 - protein, 844 aa, Artificial Sequence
  Synthetic polypeptide
MILDADYITEDGKPIIRIFKKENGEFKVEYDRNFRHYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKSGTGGGGATVKFKYKGEEKEVDISKIKKVWRVGKMISFTYDEGGGKTGRGAVSEKDAPKELLQMLEKQKK

SEQ ID NO: 102 - protein, 774 aa, Artificial Sequence
  Synthetic polypeptide
  MISC_FEATURE (764)..(764): X is selected from Q, N, H, S, T, Y, C, M, W, A, I, L, F, V, P, and G
MILDTDYITKDGKPIIRIFKKENGEFKIELDPHFQHYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSYYGYMGYPKARWYSKECAESVTAWGRHYIEMTIREIEEKFGFKVLYADTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSXQTGLDAWLKR

SEQ ID NO: 103 - protein, 774 aa, Artificial Sequence
  Synthetic polypeptide
MILDTDYITKDGKPIIRIFKKENGEFKIELDPHFQHYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSYYGYMGYPKARWYSKECAESVTAWGRHYIEMTIREIEEKFGFKVLYADTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSQQTGLDAWLKR

SEQ ID NO: 104 - protein, 774 aa, Artificial Sequence
  Synthetic polypeptide
  MISC_FEATURE (764)..(764): X is selected from Q, N, H, S, T, Y, C, M, W, A, I, L, F, V, P, and G
MILDTDYITKDGKPIIRIFKKENGEFKIELDPHFQHYIYALLKDDSAIEEIKAIKGERHGKSVRVVDAVKVKKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPVERKMLDYRQRAVKLLANSYYGYMGYPKARWYSKECAESVTAWGRHYIEMTIKEIEEKFGFKVLYADTDGFYATISGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVLEKIAKYRVPLEKLVIHEQITRDLKDYKAIGPHVAIAKRLAARGIKVKPGTIISYIVLKGSGKISDRVILLTEYDPEKHKYDPDYYIENQVLPAVLRILEAFGYRKEDLRYQSSXQTGLDAWLKR

SEQ ID NO: 105 - protein, 774 aa, Artificial Sequence
  Synthetic polypeptide
MILDTDYITKDGKPIIRIFKKENGEFKIELDPHFQHYIYALLKDDSAIEEIKAIKGERHGKSVRVVDAVKVKKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPVERKMLDYRQRAVKLLANSYYGYMGYPKARWYSKECAESVTAWGRHYIEMTIKEIEEKFGFKVLYADTDGFYATISGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVLEKIAKYRVPLEKLVIHEQITRDLKDYKAIGPHVAIAKRLAARGIKVKPGTIISYIVLKGSGKISDRVILLTEYDPEKHKYDPDYYIENQVLPAVLRILEAFGYRKEDLRYQSSQQTGLDAWLKR

SEQ ID NO: 106 - protein, 773 aa, Artificial Sequence
  Synthetic polypeptide
  MISC_FEATURE (761)..(761): X is selected from Q, N, H, S, T, Y, C, M, W, A, I, L, F, V, P, and G
MILDTDYITEDGKPVIRIFKKENGEFKIDYDRNFEHYIYALLKDDSAIEDVKKITAERHGTTVRVVRAEKVKKKFLGRPIEVWKLYFTHPQDVPAIRDKIKEHPAVVDIYEYDIPFAKRYLIDKGLIPMEGDEELKMLAFDIETLYHEGEEFAEGPILMISYADEEGARVITWKNIDLPYVDVVSTEKEMIKRFLKVVKEKDPDVLITYNGDNFDFAYLKKRSEKLGVKFILGREGSEPKIQRMGDRFAVEVKGRIHFDLYPVIRRTINLPTYTLEAVYEAIFGQPKEKVYAEEIAQAWETGEGLERVARYSMEDAKVTYELGKEFFPMEAQLSRLVGQSLWDVSRSSTGNLVEWFLLRKAYERNELAPNKPDERELARRRESYAGGYVKEPERGLWENIVYLDFRSLYPSIIITHNVSPDTLNREGCEEYDVAPQVGHKFCKDFPGFIPSLLGDLLEERQKVKKKMKATIDPIEKKLLDYRQRAIKILANSFYGYYGYAKARWYCKECAESVTAWGRQYIETTIREIEEKFGFKVLYADTDGFFATIPGADAETVKKKAKEFLDYINAKLPGLLELEYEGFYKRGFFVTKKKYAVIDEEDKITTRGLEIVRRDWSEIAKETQARVLEAILKHGDVEEAVRIVKEVTEKLSKYEVPPEKLVIYEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTXQVGLGAWLKPKT

SEQ ID NO: 107 - protein, 773 aa, Artificial Sequence
  Synthetic polypeptide
MILDTDYITEDGKPVIRIFKKENGEFKIDYDRNFEHYIYALLKDDSAIEDVKKITAERHGTTVRVVRAEKVKKKFLGRPIEVWKLYFTHPQDVPAIRDKIKEHPAVVDIYEYDIPFAKRYLIDKGLIPMEGDEELKMLAFDIETLYHEGEEFAEGPILMISYADEEGARVITWKNIDLPYVDVVSTEKEMIKRFLKVVKEKDPDVLITYNGDNFDFAYLKKRSEKLGVKFILGREGSEPKIQRMGDRFAVEVKGRIHFDLYPVIRRTINLPTYTLEAVYEAIFGQPKEKVYAEEIAQAWETGEGLERVARYSMEDAKVTYELGKEFFPMEAQLSRLVGQSLWDVSRSSTGNLVEWFLLRKAYERNELAPNKPDERELARRRESYAGGYVKEPERGLWENIVYLDFRSLYPSIIITHNVSPDTLNREGCEEYDVAPQVGHKFCKDFPGFIPSLLGDLLEERQKVKKKMKATIDPIEKKLLDYRQRAIKILANSFYGYYGYAKARWYCKECAESVTAWGRQYIETTIREIEEKFGFKVLYADTDGFFATIPGADAETVKKKAKEFLDYINAKLPGLLELEYEGFYKRGFFVTKKKYAVIDEEDKITTRGLEIVRRDWSEIAKETQARVLEAILKHGDVEEAVRIVKEVTEKLSKYEVPPEKLVIYEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTQQVGLGAWLKPKT

SEQ ID NO: 108 - protein, 774 aa, Artificial Sequence
  Synthetic polypeptide
  MISC_FEATURE (761)..(761): X is selected from Q, N, H, S, T, Y, C, M, W, A, I, L, F, V, P, and G
MILDTDYITEDGKPVIRIFKKENGEFKIEYDRTFEHYFYALLKDDSAIEEVKKITAERHGTVVTVKRVEKVQKKFLGRPVEVWKLYFTHPQDVPAIRDKIREHPAVIDIYEYDIPFAKRYLIDKGLVPMEGDEELKMLAFDIETLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITTAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFRSLYPSIIITHNVSPDTLNREGCKEYDVAPQVGHRFCKDFPGFIPSLLGDLLEERQKIKKKMKATIDPIERKLLDYRQRAIKILANSYYGYYGYARARWYCKECAESVTAWGREYITMTIKEIEEKYGFKVIYSDTDGFFATIPGADAETVKKKAMEFLKYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTXQVGLSAWLKPKGT

SEQ ID NO: 109 - protein, 774 aa, Artificial Sequence
  Synthetic polypeptide
MILDTDYITEDGKPVIRIFKKENGEFKIEYDRTFEHYFYALLKDDSAIEEVKKITAERHGTVVTVKRVEKVQKKFLGRPVEVWKLYFTHPQDVPAIRDKIREHPAVIDIYEYDIPFAKRYLIDKGLVPMEGDEELKMLAFDIETLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITTAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFRSLYPSIIITHNVSPDTLNREGCKEYDVAPQVGHRFCKDFPGFIPSLLGDLLEERQKIKKKMKATIDPIERKLLDYRQRAIKILANSYYGYYGYARARWYCKECAESVTAWGREYITMTIKEIEEKYGFKVIYSDTDGFFATIPGADAETVKKKAMEFLKYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTQQVGLSAWLKPKGT

SEQ ID NO: 110 - protein, 775 aa, Artificial Sequence
  Synthetic polypeptide
  MISC_FEATURE (761)..(761): X is selected from Q, N, H, S, T, Y, C, M, W, A, I, L, F, V, P, and G
MILDTDYITENGKPVIRVFKKENGEFKIEYDRTFEHYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTXQVGLGAWLKVKGKK

SEQ ID NO: 111 - protein, 775 aa, Artificial Sequence
  Synthetic polypeptide
MILDTDYITENGKPVIRVFKKENGEFKIEYDRTFEHYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTQQVGLGAWLKVKGKK

SEQ ID NO: 112 - protein, 783 aa, Artificial Sequence
  Synthetic polypeptide
MRFWPLDATYSVVGGVPEVRVFGVDGEGRRVVLVDRRFRHYFYAKCDKCDASLAKSYLSRVAPVEAVEVVERRFFGRPTIFLKVVAKVPEDVRKLREAALGAPGVVDVYEADIRYYMRYMIDKGVVPCAWNVVEAREAGKLGPLPLYEVVEWAGVEEGFPPPLRVLAFDIEVYNERGSPDPLRDPVVMLAVKTSDGREEVFEAEGRDDRRVIRGFVDFVKEFDPDVIVGYNSNGFDWPYLSERAKALGVPLRVDRLGGVPQQSVYGHWSVVGRANVDLYNIVDEFPEIKVKTLDRVAEYFGVMKRSERVLIPGHKVYEYWNDPAKRPTLMRYVLDDVRSTLGLAEKLLPFLIQLSSVSGLPLDQVAAASVGNRVEWMLLRYAYRMGEVAPNREEREYEPYKGAIVLEPKPGLYSDVLVLDFSSMYPNIMMKYNLSPDTYLEPHEPDPPEGVVVAPEVGHRFRKAPTGFIPAVLKHLVELRRAVREEAKKYPPDSPEYRLLDERQRALKVMANAMYGYLGWVGARWYKKEVAESVTAFARAILLDVVEYAKRLGIEVIYGDTDSLFVKKSGAVDRLVKYVEERHGIEIKVDKDYERVLFTEAKKRYAGLLRDGRIDIVGFEVVRGDWCELAKEVQLNVVELILKSKSVGEARERVVKYVREVVERLKAYKFDLDDLIIWKTLDKELDEYKAYGPHVHAALELKRRGYKVGKGTTVGYVIVRGPGKVSERAMPYIFVDDASKVDVDYYIEKQVIPAALRIAEVLGVKESDLKTGRVQKSLLDFLG

SEQ ID NO: 113 - protein, 785 aa, Artificial Sequence
  Synthetic polypeptide
MKFKLWPLDATYSVVGGVPEVRIFGISESGDRVVVVDRRFRHYFYADCPACDPESVRSQLGRVAPVEEVVAVERRYLGRPRSFLKIVARVPEDVRKLREAAAALPGVSGVYEADIRFYMRYMLDMGVVPCSWNTVDAEATGEKLGNLPVYKVAEWGGVTEGFPPPLRVLAFDIEVYNERGTPDPLRDPVILLAVQASDGRVEVFEASGRDDRSVLRSFIDFVREFDPDVIVGYNSNQFDWPYLAERARALGIPLKVDRVGGAPQQSVYGHWSVTGRANVDLYNIVDEFPEIKLKTLDRVAEYFGVMKREERVLVPGHKIYEYWRDQGKRPLLRQYVIDDVKSTYGLAEKLLPFLIQLSSVSGLPLDQVAAASVGNRVEWMLLRYAYRLGEVAPNREEREYEPYKGAIVLEPRPGLYSDVLALDFSSMYPNIMMKYNLSPDTYLERGEPDPPGGVYVAPEVGHRFRREPPGFIPLVLRQLIELRKRVREELKKYPPDSPEYRVLDERQRALKIMANAMYGYTGWVGARWYKKEVAESVTAFARAILKDVIEYARKAGIVVIYGDTDSLFVKKSGDVEKLVKYVEEKYGIDIKIDKDYSTVLFTEAKKRYAGLLRDGRIDIVGFEVVRGDWSELAKEVQLRVIELILTSRDVSEARQKVVKYVRGVIDKLRNYEVDLDDLIIWKTLDKELDEYKAYPPHVHAAILLKKRGYKVGKGTTIGYVVVKGGEKVSERAVPYIFIDDIEKIDLDYYVERQVIPAALRIAEVIGIKEGDLKTGRSQRTLLDFF

SEQ ID NO: 114 - protein, 766 aa, Artificial Sequence
  Synthetic polypeptide
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTKQTGL

SEQ ID NO: 115 - protein, 131 aa, Artificial Sequence
  Synthetic polypeptide
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEG

SEQ ID NO: 116 - protein, 131 aa, Artificial Sequence
  Synthetic polypeptide
MILDVDYITEEGKPVIRLFKKENGKFKIEHDRTFRHYIYALLRDDSKIEEVKKITGERHGKIVRIVDVEKVEKKFLGKPITVWKLYLEHPQDVPTIREKVREHPAVVDIFEYDIPFAKRYLIDKGLIPMEG

SEQ ID NO: 117 - protein, 131 aa, Artificial Sequence
  Synthetic polypeptide
MILDADYITEDGKPIIRIFKKENGEFKVEYDRNFRHYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEG

SEQ ID NO: 118 - protein, 131 aa, Artificial Sequence
  Synthetic polypeptide
MILDTDYITKDGKPIIRIFKKENGEFKIELDPHFQHYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEG

SEQ ID NO: 119 - protein, 131 aa, Artificial Sequence
  Synthetic polypeptide
MILDTDYITEDGKPVIRIFKKENGEFKIDYDRNFEHYIYALLKDDSAIEDVKKITAERHGTTVRVVRAEKVKKKFLGRPIEVWKLYFTHPQDVPAIRDKIKEHPAVVDIYEYDIPFAKRYLIDKGLIPMEG

SEQ ID NO: 120 - protein, 131 aa, Artificial Sequence
  Synthetic polypeptide
MILDTDYITEDGKPVIRIFKKENGEFKIEYDRTFEHYFYALLKDDSAIEEVKKITAERHGTVVTVKRVEKVQKKFLGRPVEVWKLYFTHPQDVPAIRDKIREHPAVIDIYEYDIPFAKRYLIDKGLVPMEG

SEQ ID NO: 121 - protein, 131 aa, Artificial Sequence
  Synthetic polypeptide
MILDTDYITENGKPVIRVFKKENGEFKIEYDRTFEHYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEG

SEQ ID NO: 122 - DNA, 20 bp, Artificial Sequence
  Synthetic oligonucleotide
acctgggaggcttttctgta

SEQ ID NO: 123 - DNA, 24 bp, Artificial Sequence
  Synthetic oligonucleotide
gtttatggaggtcctcttgtgtcc

SEQ ID NO: 124 - DNA, 21 bp, Artificial Sequence
  Synthetic oligonucleotide
gggtcaacgctaggctggcag

SEQ ID NO: 125 - DNA, 20 bp, Artificial Sequence
  Synthetic oligonucleotide
tctggacgggcatctcaagt

SEQ ID NO: 126 - DNA, 20 bp, Artificial Sequence
  Synthetic oligonucleotide
ttcacaggaagcactcacca

SEQ ID NO: 127 - protein, 775 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKS

SEQ ID NO: 128 - protein, 775 aa, Artificial Sequence
  Synthetic polypeptide
  MISC_FEATURE (36)..(36): X is any amino acid other than P
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKS

SEQ ID NO: 129 - protein, 775 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKS

SEQ ID NO: 130 - protein, 775 aa, Artificial Sequence
  Synthetic polypeptide
  MISC_FEATURE (36)..(36): X is any amino acid other than P
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKS

SEQ ID NO: 131 - protein, 844 aa, Artificial Sequence
  Syntethic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKSGTGGGGATVKFKYKGEEKEVDISKIKKVWRVGKMISFTYDEGGGKTGRGAVSEKDAPKELLQMLEKQKK

SEQ ID NO: 132 - protein, 844 aa, Artificial Sequence
  Synthetic polypeptide
  MISC_FEATURE (36)..(36): X is any amino acid other than P
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRALYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKSGTGGGGATVKFKYKGEEKEVDISKIKKVWRVGKMISFTYDEGGGKTGRGAVSEKDAPKELLQMLEKQKK

SEQ ID NO: 133 - protein, 844 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTXQVGLTSWLNIKKSGTGGGGATVKFKYKGEEKEVDISKIKKVWRVGKMISFTYDEGGGKTGRGAVSEKDAPKELLQMLEKQKK

SEQ ID NO: 134 - protein, 844 aa, Artificial Sequence
  Synthetic polypeptide
  MISC_FEATURE (36)..(36): X is any amino acid other than P
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEGEEELKILAFDIETLYHEGEEFGKGPIIMISYADENEAKVITWKNIDLPYVEVVSSEREMIKRFLRIIREKDPDIIVTYNGDSFDFPYLAKRAEKLGIKLTIGRDGSEPKMQRIGDMTAVEVKGRIHFDLYHVITRTINLPTYTLEAVYEAIFGKPKEKVYADEIAKAWESGENLERVAKYSMEDAKATYELGKEFLPMEIQLSRLVGQPLWDVSRSSTGNLVEWFLLRKAYERNEVAPNKPSEEEYQRRLRESYTGGFVKEPEKGLWENIVYLDFRSLYPSIIITHNVSPDTLNLEGCKNYDIAPQVGHKFCKDIPGFIPSLLGHLLEERQKIKTKMKETQDPIEKILLDYRQKAIKLLANSFYGYYGYAKARWYCKECAESVTAWGRKYIELVWKELEEKFGFKVLYIDTDGLYATIPGGESEEIKKKALEFVKYINSKLPGLLELEYEGFYKRGFFVTKKRYAVIDEEGKVITRGLEIVRRDWSEIAKETQARVLETILKHGDVEEAVRIVKEVIQKLANYEIPPEKLAIYEQITRPLHEYKAIGPHVAVAKKLAAKGVKIKPGMVIGYIVLRGDGPISNRAILAEEYDPKKHKYDAEYYIENQVLPAVLRILEGFGYRKEDLRYQKTQQVGLTSWLNIKKSGTGGGGATVKFKYKGEEKEVDISKIKKVWRVGKMISFTYDEGGGKTGRGAVSEKDAPKELLQMLEKQKK

SEQ ID NO: 135 - protein, 766 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGL

SEQ ID NO: 136 - protein, 766 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGL

SEQ ID NO: 137 - protein, 766 aa, Artificial Sequence
  Synthetic polypeptide
  MISC_FEATURE (36)..(36): X is any amino acid other than P
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGL

SEQ ID NO: 138 - protein, 766 aa, Artificial Sequence
  Synthetic polypeptide
  MISC_FEATURE (36)..(36): X is any amino acid other than P
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGL

SEQ ID NO: 139 - protein, 844 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGLTSWLNIKKSGTGGGGATVKFKYKGEEKEVDISKIKKVWRVGKMISFTYDEGGGKTGRGAVSEKDAPKELLQMLEKQKK

SEQ ID NO: 140 - protein, 844 aa, Artificial Sequence
  Synthetic polypeptide
  MISC_FEATURE (36)..(36): X is any amino acid other than P
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGLTSWLNIKKSGTGGGGATVKFKYKGEEKEVDISKIKKVWRVGKMISFTYDEGGGKTGRGAVSEKDAPKELLQMLEKQKK

SEQ ID NO: 141 - protein, 844 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTXQTGLTSWLNIKKSGTGGGGATVKFKYKGEEKEVDISKIKKVWRVGKMISFTYDEGGGKTGRGAVSEKDAPKELLQMLEKQKK

SEQ ID NO: 142 - protein, 844 aa, Artificial Sequence
  Synthetic polypeptide
  MISC_FEATURE (36)..(36): X is any amino acid other than P
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRSLYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTQQTGLTSWLNIKKSGTGGGGATVKFKYKGEEKEVDISKIKKVWRVGKMISFTYDEGGGKTGRGAVSEKDAPKELLQMLEKQKK

SEQ ID NO: 143 - protein, 775 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDADYITEDGKPIIRIFKKENGEFKVEYDRNFRXYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKK

SEQ ID NO: 144 - protein, 775 aa, Artificial Sequence
  Synthetic polypeptide
  MISC_FEATURE (36)..(36): X is any amino acid other than P
MILDADYITEDGKPIIRIFKKENGEFKVEYDRNFRXYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKK

SEQ ID NO: 145 - protein, 844 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDADYITEDGKPIIRIFKKENGEFKVEYDRNFRXYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKKGTGGGGATVKFKYKGEEKEVDISKIKKVWRVGKMISFTYDEGGGKTGRGAVSEKDAPKELLQMLEKQKK

SEQ ID NO: 146 - protein, 844 aa, Artificial Sequence
  Synthetic polypeptide
  MISC_FEATURE (36)..(36): X is any amino acid other than P
MILDADYITEDGKPIIRIFKKENGEFKVEYDRNFRXYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKKGTGGGGATVKFKYKGEEKEVDISKIKKVWRVGKMISFTYDEGGGKTGRGAVSEKDAPKELLQMLEKQKK

SEQ ID NO: 147 - protein, 844 aa, Artificial Sequence
  Synthetic polypeptide
  MISC_FEATURE (36)..(36): X is any amino acid other than P
  MISC_FEATURE (762)..(762): X is selected from Q, N, H, S, T, Y, C, M, W, A, I, L, F, V, P, and G
MILDADYITEDGKPIIRIFKKENGEFKVEYDRNFRXYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTXQTGLTAWLNIKKSGTGGGGATVKFKYKGEEKEVDISKIKKVWRVGKMISFTYDEGGGKTGRGAVSEKDAPKELLQMLEKQKK

SEQ ID NO: 148 - protein, 844 aa, Artificial Sequence
  Synthetic polypeptide
  MISC_FEATURE (36)..(36): X is any amino acid other than P
MILDADYITEDGKPIIRIFKKENGEFKVEYDRNFRXYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEGDEELKLLAFDIETLYHEGEEFAKGPIIMISYADEEEAKVITWKKIDLPYVEVVSSEREMIKRFLKVIREKDPDVIITYNGDSFDLPYLVKRAEKLGIKLPLGRDGSEPKMQRLGDMTAVEIKGRIHFDLYHVIRRTINLPTYTLEAVYEAIFGKPKEKVYAHEIAEAWETGKGLERVAKYSMEDAKVTYELGREFFPMEAQLSRLVGQPLWDVSRSSTGNLVEWYLLRKAYERNELAPNKPDEREYERRLRESYAGGYVKEPEKGLWEGLVSLDFRSLYPSIIITHNVSPDTLNREGCREYDVAPEVGHKFCKDFPGFIPSLLKRLLDERQEIKRKMKASKDPIEKKMLDYRQRAIKILANSYYGYYGYAKARWYCKECAESVTAWGREYIEFVRKELEEKFGFKVLYIDTDGLYATIPGAKPEEIKKKALEFVDYINAKLPGLLELEYEGFYVRGFFVTKKKYALIDEEGKIITRGLEIVRRDWSEIAKETQAKVLEAILKHGNVEEAVKIVKEVTEKLSKYEIPPEKLVIYEQITRPLHEYKAIGPHVAVAKRLAARGVKVRPGMVIGYIVLRGDGPISKRAILAEEFDLRKHKYDAEYYIENQVLPAVLRILEAFGYRKEDLRWQKTQQTGLTAWLNIKKSGTGGGGATVKFKYKGEEKEVDISKIKKVWRVGKMISFTYDEGGGKTGRGAVSEKDAPKELLQMLEKQKK

SEQ ID NO: 149 - protein, 774 aa, Artificial Sequence
  Synthetic polypeptide
  MISC_FEATURE (36)..(36): X is any amino acid other than P
  MISC_FEATURE (764)..(764): X is selected from Q, N, H, S, T, Y, C, M, W, A, I, L, F, V, P, and G
MILDTDYITKDGKPIIRIFKKENGEFKIELDPHFQXYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSYYGYMGYPKARWYSKECAESVTAWGRHYIEMTIREIEEKFGFKVLYADTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSXQTGLDAWLKR

SEQ ID NO: 150 - protein, 774 aa, Artificial Sequence
  Synthetic polypeptide
  MISC_FEATURE (36)..(36): X is any amino acid other than P
MILDTDYITKDGKPIIRIFKKENGEFKIELDPHFQXYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKEHPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYARNELAPNKPDEEEYKRRLRTTYLGGYVKEPEKGLWENIIYLDFRSLYPSIIVTHNVSPDTLEKEGCKNYDVAPIVGYRFCKDFPGFIPSILGDLIAMRQDIKKKMKSTIDPIEKKMLDYRQRAIKLLANSYYGYMGYPKARWYSKECAESVTAWGRHYIEMTIREIEEKFGFKVLYADTDGFYATIPGEKPELIKKKAKEFLNYINSKLPGLLELEYEGFYLRGFFVTKKRYAVIDEEGRITTRGLEVVRRDWSEIAKETQAKVLEAILKEGSVEKAVEVVRDVVEKIAKYRVPLEKLVIHEQITRDLKDYKAIGPHVAIAKRLAARGIKVKPGTIISYIVLKGSGKISDRVILLTEYDPRKHKYDPDYYIENQVLPAVLRILEAFGYRKEDLRYQSSQQTGLDAWLKR

SEQ ID NO: 151 - protein, 774 aa, Artificial Sequence
  Synthetic polypeptide
  MISC_FEATURE (36)..(36): X is any amino acid other than P
  MISC_FEATURE (764)..(764): X is selected from Q, N, H, S, T, Y, C, M, W, A, I, L, F, V, P, and G
MILDTDYITKDGKPIIRIFKKENGEFKIELDPHFQXYIYALLKDDSAIEEIKAIKGERHGKSVRVVDAVKVKKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPVERKMLDYRQRAVKLLANSYYGYMGYPKARWYSKECAESVTAWGRHYIEMTIKEIEEKFGFKVLYADTDGFYATISGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVLEKIAKYRVPLEKLVIHEQITRDLKDYKAIGPHVAIAKRLAARGIKVKPGTIISYIVLKGSGKISDRVILLTEYDPEKHKYDPDYYIENQVLPAVLRILEAFGYRKEDLRYQSSXQTGLDAWLKR

SEQ ID NO: 152 - protein, 774 aa, Artificial Sequence
  Synthetic polypeptide
  MISC_FEATURE (36)..(36): X is any amino acid other than P
MILDTDYITKDGKPIIRIFKKENGEFKIELDPHFQXYIYALLKDDSAIEEIKAIKGERHGKSVRVVDAVKVKKKFLGREVEVWKLIFEHPQDVPAMRDKIKEHPAVIDIYEYDIPFAKRYLIDKGLIPMEGDEELKLLAFDIETFYHEGDEFGKGEIIMISYADEEEARVITWKNIDLPYVDVVSNEREMIKRFVQVVKEKDPDVIITYNGDNFDLPYLIKRAEKLGVRLVLGRDKENPEPKIQRMGDSFAVEIKGRIHFDLFPVVRRTINLPTYTLEAVYEAVLGKTKSKLGAEEIAAIWETEESMKKLAQYSMEDARATYELGKEFFPMEAELAKLIGQSVWDVSRSSTGNLVEWYLLRVAYERNELAPNKPDEEEYKRRLRTTYLGGYVKEPEKGLWENIIYLDFRSLYPSIIVTHNVSPDTLEKEGCENYDIAPIVSYRFCKDFPGFIPSILGDLIAMRQEIKKKMKATIDPVERKMLDYRQRAVKLLANSYYGYMGYPKARWYSKECAESVTAWGRHYIEMTIKEIEEKFGFKVLYADTDGFYATISGEKPEIIKKKAREFLNYINSKLPGLLELEYEGFYLRGFFVTKKRYAVIDEEGRITTRGLEVVRRDWSEIAKETQAKVLEAILKDGSVEKAVEIVRDVLEKIAKYRVPLEKLVIHEQITRDLKDYKAIGPHVAIAKRLAARGIKVKPGTIISYIVLKGSGKISDRVILLTEYDPEKHKYDPDYYIENQVLPAVLRILEAFGYRKEDLRYQSSQQTGLDAWLKR

SEQ ID NO: 153 - protein, 773 aa, Artificial Sequence
  Synthetic polypeptide
  MISC_FEATURE (36)..(36): X is any amino acid other than P
  MISC_FEATURE (761)..(761): X is selected from Q, N, H, S, T, Y, C, M, W, A, I, L, F, V, P, and G
MILDTDYITEDGKPVIRIFKKENGEFKIDYDRNFEXYIYALLKDDSAIEDVKKITAERHGTTVRVVRAEKVKKKFLGRPIEVWKLYFTHPQDVPAIRDKIKEHPAVVDIYEYDIPFAKRYLIDKGLIPMEGDEELKMLAFDIETLYHEGEEFAEGPILMISYADEEGARVITWKNIDLPYVDVVSTEKEMIKRFLKVVKEKDPDVLITYNGDNFDFAYLKKRSEKLGVKFILGREGSEPKIQRMGDRFAVEVKGRIHFDLYPVIRRTINLPTYTLEAVYEAIFGQPKEKVYAEEIAQAWETGEGLERVARYSMEDAKVTYELGKEFFPMEAQLSRLVGQSLWDVSRSSTGNLVEWFLLRKAYERNELAPNKPDERELARRRESYAGGYVKEPERGLWENIVYLDFRSLYPSIIITHNVSPDTLNREGCEEYDVAPQVGHKFCKDFPGFIPSLLGDLLEERQKVKKKMKATIDPIEKKLLDYRQRAIKILANSFYGYYGYAKARWYCKECAESVTAWGRQYIETTIREIEEKFGFKVLYADTDGFFATIPGADAETVKKKAKEFLDYINAKLPGLLELEYEGFYKRGFFVTKKKYAVIDEEDKITTRGLEIVRRDWSEIAKETQARVLEAILKHGDVEEAVRIVKEVTEKLSKYEVPPEKLVIYEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTXQVGLGAWLKPKT

SEQ ID NO: 154 - protein, 773 aa, Artificial Sequence
  Synthetic polypeptide
  MISC_FEATURE (36)..(36): X is any amino acid other than P
MILDTDYITEDGKPVIRIFKKENGEFKIDYDRNFEXYIYALLKDDSAIEDVKKITAERHGTTVRVVRAEKVKKKFLGRPIEVWKLYFTHPQDVPAIRDKIKEHPAVVDIYEYDIPFAKRYLIDKGLIPMEGDEELKMLAFDIETLYHEGEEFAEGPILMISYADEEGARVITWKNIDLPYVDVVSTEKEMIKRFLKVVKEKDPDVLITYNGDNFDFAYLKKRSEKLGVKFILGREGSEPKIQRMGDRFAVEVKGRIHFDLYPVIRRTINLPTYTLEAVYEAIFGQPKEKVYAEEIAQAWETGEGLERVARYSMEDAKVTYELGKEFFPMEAQLSRLVGQSLWDVSRSSTGNLVEWFLLRKAYERNELAPNKPDERELARRRESYAGGYVKEPERGLWENIVYLDFRSLYPSIIITHNVSPDTLNREGCEEYDVAPQVGHKFCKDFPGFIPSLLGDLLEERQKVKKKMKATIDPIEKKLLDYRQRAIKILANSFYGYYGYAKARWYCKECAESVTAWGRQYIETTIREIEEKFGFKVLYADTDGFFATIPGADAETVKKKAKEFLDYINAKLPGLLELEYEGFYKRGFFVTKKKYAVIDEEDKITTRGLEIVRRDWSEIAKETQARVLEAILKHGDVEEAVRIVKEVTEKLSKYEVPPEKLVIYEQITRDLKDYKATGPHVAVAKRLAARGIKIRPGTVISYIVLKGSGRIGDRAIPFDEFDPAKHKYDAEYYIENQVLPAVERILRAFGYRKEDLRYQKTQQVGLGAWLKPKT

SEQ ID NO: 155 - protein, 774 aa, Artificial Sequence
  Synthetic polypeptide
  MISC_FEATURE (36)..(36): X is any amino acid other than P
  MISC_FEATURE (761)..(761): X is selected from Q, N, H, S, T, Y, C, M, W, A, I, L, F, V, P, and G
MILDTDYITEDGKPVIRIFKKENGEFKIEYDRTFEXYFYALLKDDSAIEEVKKITAERHGTVVTVKRVEKVQKKFLGRPVEVWKLYFTHPQDVPAIRDKIREHPAVIDIYEYDIPFAKRYLIDKGLVPMEGDEELKMLAFDIETLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITTAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFRSLYPSIIITHNVSPDTLNREGCKEYDVAPQVGHRFCKDFPGFIPSLLGDLLEERQKIKKKMKATIDPIERKLLDYRQRAIKILANSYYGYYGYARARWYCKECAESVTAWGREYITMTIKEIEEKYGFKVIYSDTDGFFATIPGADAETVKKKAMEFLKYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTXQVGLSAWLKPKGT

SEQ ID NO: 156 - protein, 774 aa, Artificial Sequence
  Synthetic polypeptide
  MISC_FEATURE (36)..(36): X is any amino acid other than P
MILDTDYITEDGKPVIRIFKKENGEFKIEYDRTFEXYFYALLKDDSAIEEVKKITAERHGTVVTVKRVEKVQKKFLGRPVEVWKLYFTHPQDVPAIRDKIREHPAVIDIYEYDIPFAKRYLIDKGLVPMEGDEELKMLAFDIETLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITTAWETGENLERVARYSMEDAKVTYELGKEFLPMEAQLSRLIGQSLWDVSRSSTGNLVEWFLLRKAYERNELAPNKPDEKELARRRQSYEGGYVKEPERGLWENIVYLDFRSLYPSIIITHNVSPDTLNREGCKEYDVAPQVGHRFCKDFPGFIPSLLGDLLEERQKIKKKMKATIDPIERKLLDYRQRAIKILANSYYGYYGYARARWYCKECAESVTAWGREYITMTIKEIEEKYGFKVIYSDTDGFFATIPGADAETVKKKAMEFLKYINAKLPGALELEYEGFYKRGFFVTKKKYAVIDEEGKITTRGLEIVRRDWSEIAKETQARVLEALLKDGDVEKAVRIVKEVTEKLSKYEVPPEKLVIHEQITRDLKDYKATGPHVAVAKRLAARGVKIRPGTVISYIVLKGSGRIGDRAIPFDEFDPTKHKYDAEYYIENQVLPAVERILRAFGYRKEDLRYQKTQQVGLSAWLKPKGT

SEQ ID NO: 157 - protein, 775 aa, Artificial Sequence
  Synthetic polypeptide
  MISC_FEATURE (36)..(36): X is any amino acid other than P
  MISC_FEATURE (761)..(761): X is selected from Q, N, H, S, T, Y, C, M, W, A, I, L, F, V, P, and G
MILDTDYITENGKPVIRVFKKENGEFKIEYDRTFEXYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTXQVGLGAWLKVKGKK

SEQ ID NO: 158 - protein, 775 aa, Artificial Sequence
  Synthetic polypeptide
  MISC_FEATURE (36)..(36): X is any amino acid other than P
MILDTDYITENGKPVIRVFKKENGEFKIEYDRTFEXYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEGDEELTMLAFDIETLYHEGEEFGTGPILMISYADGSEARVITWKKIDLPYVDVVSTEKEMIKRFLRVVREKDPDVLITYNGDNFDFAYLKKRCEELGIKFTLGRDGSEPKIQRMGDRFAVEVKGRIHFDLYPVIRRTINLPTYTLEAVYEAVFGKPKEKVYAEEIAQAWESGEGLERVARYSMEDAKVTYELGREFFPMEAQLSRLIGQSLWDVSRSSTGNLVEWFLLRKAYKRNELAPNKPDERELARRRGGYAGGYVKEPERGLWDNIVYLDFRSLYPSIIITHNVSPDTLNREGCKEYDVAPEVGHKFCKDFPGFIPSLLGDLLEERQKIKRKMKATVDPLEKKLLDYRQRAIKILANSFYGYYGYAKARWYCKECAESVTAWGREYIEMVIRELEEKFGFKVLYADTDGLHATIPGADAETVKKKAKEFLKYINPKLPGLLELEYEGFYVRGFFVTKKKYAVIDEEGKITTRGLEIVRRDWSEIAKETQARVLEAILKHGDVEEAVRIVKEVTEKLSKYEVPPEKLVIHEQITRDLRDYKATGPHVAVAKRLAARGVKIRPGTVISYIVLKGSGRIGDRAIPADEFDPTKHRYDAEYYIENQVLPAVERILKAFGYRKEDLRYQKTQQVGLGAWLKVKGKK

SEQ ID NO: 159 - protein, 783 aa, Artificial Sequence
  Synthetic polypeptide
  MISC_FEATURE (40)..(40): X is any amino acid other than P
MRFWPLDATYSVVGGVPEVRVFGVDGEGRRVVLVDRRFRXYFYAKCDKCDASLAKSYLSRVAPVEAVEVVERRFFGRPTIFLKVVAKVPEDVRKLREAALGAPGVVDVYEADIRYYMRYMIDKGVVPCAWNVVEAREAGKLGPLPLYEVVEWAGVEEGFPPPLRVLAFDIEVYNERGSPDPLRDPVVMLAVKTSDGREEVFEAEGRDDRRVIRGFVDFVKEFDPDVIVGYNSNGFDWPYLSERAKALGVPLRVDRLGGVPQQSVYGHWSVVGRANVDLYNIVDEFPEIKVKTLDRVAEYFGVMKRSERVLIPGHKVYEYWNDPAKRPTLMRYVLDDVRSTLGLAEKLLPFLIQLSSVSGLPLDQVAAASVGNRVEWMLLRYAYRMGEVAPNREEREYEPYKGAIVLEPKPGLYSDVLVLDFSSMYPNIMMKYNLSPDTYLEPHEPDPPEGVVVAPEVGHRFRKAPTGFIPAVLKHLVELRRAVREEAKKYPPDSPEYRLLDERQRALKVMANAMYGYLGWVGARWYKKEVAESVTAFARAILLDVVEYAKRLGIEVIYGDTDSLFVKKSGAVDRLVKYVEERHGIEIKVDKDYERVLFTEAKKRYAGLLRDGRIDIVGFEVVRGDWCELAKEVQLNVVELILKSKSVGEARERVVKYVREVVERLKAYKFDLDDLIIWKTLDKELDEYKAYGPHVHAALELKRRGYKVGKGTTVGYVIVRGPGKVSERAMPYIFVDDASKVDVDYYIEKQVIPAALRIAEVLGVKESDLKTGRVQKSLLDFLG

SEQ ID NO: 160 - protein, 785 aa, Artificial Sequence
  Synthetic polypeptide
  MISC_FEATURE (42)..(42): X is any amino acid other than P
MKFKLWPLDATYSVVGGVPEVRIFGISESGDRVVVVDRRFRXYFYADCPACDPESVRSQLGRVAPVEEVVAVERRYLGRPRSFLKIVARVPEDVRKLREAAAALPGVSGVYEADIRFYMRYMLDMGVVPCSWNTVDAEATGEKLGNLPVYKVAEWGGVTEGFPPPLRVLAFDIEVYNERGTPDPLRDPVILLAVQASDGRVEVFEASGRDDRSVLRSFIDFVREFDPDVIVGYNSNQFDWPYLAERARALGIPLKVDRVGGAPQQSVYGHWSVTGRANVDLYNIVDEFPEIKLKTLDRVAEYFGVMKREERVLVPGHKIYEYWRDQGKRPLLRQYVIDDVKSTYGLAEKLLPFLIQLSSVSGLPLDQVAAASVGNRVEWMLLRYAYRLGEVAPNREEREYEPYKGAIVLEPRPGLYSDVLALDFSSMYPNIMMKYNLSPDTYLERGEPDPPGGVYVAPEVGHRFRREPPGFIPLVLRQLIELRKRVREELKKYPPDSPEYRVLDERQRALKIMANAMYGYTGWVGARWYKKEVAESVTAFARAILKDVIEYARKAGIVVIYGDTDSLFVKKSGDVEKLVKYVEEKYGIDIKIDKDYSTVLFTEAKKRYAGLLRDGRIDIVGFEVVRGDWSELAKEVQLRVIELILTSRDVSEARQKVVKYVRGVIDKLRNYEVDLDDLIIWKTLDKELDEYKAYPPHVHAAILLKKRGYKVGKGTTIGYVVVKGGEKVSERAVPYIFIDDIEKIDLDYYVERQVIPAALRIAEVIGIKEGDLKTGRSQRTLLDFF

SEQ ID NO: 161 - protein, 766 aa, Artificial Sequence
  Synthetic polypeptide
  MISC_FEATURE (36)..(36): X is any amino acid other than P
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTKQTGL

SEQ ID NO: 162 - protein, 131 aa, Artificial Sequence
  Synthetic polypeptide
  MISC_FEATURE (36)..(36): X is any amino acid other than P
MILDADYITEEGKPVIRLFKKENGEFKIEHDRTFRXYIYALLKDDSKIEEVKKITAERHGKIVRIVDAEKVEKKFLGRPITVWRLYFEHPQDVPTIREKIREHSAVVDIFEYDIPFAKRYLIDKGLIPMEG

SEQ ID NO: 163 - protein, 131 aa, Artificial Sequence
  Synthetic polypeptide
  MISC_FEATURE (36)..(36): X is any amino acid other than P
MILDVDYITEEGKPVIRLFKKENGKFKIEHDRTFRXYIYALLRDDSKIEEVKKITGERHGKIVRIVDVEKVEKKFLGKPITVWKLYLEHPQDVPTIREKVREHPAVVDIFEYDIPFAKRYLIDKGLIPMEG

SEQ ID NO: 164 - protein, 131 aa, Artificial Sequence
  Synthetic polypeptide
  MISC_FEATURE (36)..(36): X is any amino acid other than P
MILDADYITEDGKPIIRIFKKENGEFKVEYDRNFRXYIYALLKDDSQIDEVRKITAERHGKIVRIIDAEKVRKKFLGRPIEVWRLYFEHPQDVPAIRDKIREHSAVIDIFEYDIPFAKRYLIDKGLIPMEG

SEQ ID NO: 165 - protein, 131 aa, Artificial Sequence
  Synthetic polypeptide
  MISC_FEATURE (36)..(36): X is any amino acid other than P
MILDTDYITKDGKPIIRIFKKENGEFKIELDPHFQXYIYALLKDDSAIEEIKAIKGERHGKTVRVLDAVKVRKKFLGREVEVWKLIFEHPQDVPAMRGKIREHPAVVDIYEYDIPFAKRYLIDKGLIPMEG

SEQ ID NO: 166 - protein, 131 aa, Artificial Sequence
  Synthetic polypeptide
  MISC_FEATURE (36)..(36): X is any amino acid other than P
MILDTDYITEDGKPVIRIFKKENGEFKIDYDRNFEXYIYALLKDDSAIEDVKKITAERHGTTVRVVRAEKVKKKFLGRPIEVWKLYFTHPQDVPAIRDKIKEHPAVVDIYEYDIPFAKRYLIDKGLIPMEG

SEQ ID NO: 167 - protein, 131 aa, Artificial Sequence
  Synthetic polypeptide
  MISC_FEATURE (36)..(36): X is any amino acid other than P
MILDTDYITEDGKPVIRIFKKENGEFKIEYDRTFEXYFYALLKDDSAIEEVKKITAERHGTVVTVKRVEKVQKKFLGRPVEVWKLYFTHPQDVPAIRDKIREHPAVIDIYEYDIPFAKRYLIDKGLVPMEG

SEQ ID NO: 168 - protein, 131 aa, Artificial Sequence
  Synthetic polypeptide
  MISC_FEATURE (36)..(36): X is any amino acid other than P
MILDTDYITENGKPVIRVFKKENGEFKIEYDRTFEXYFYALLKDDSAIEDVKKVTAKRHGTVVKVKRAEKVQKKFLGRPIEVWKLYFNHPQDVPAIRDRIRAHPAVVDIYEYDIPFAKRYLIDKGLIPMEG

SEQ ID NO: 169 - protein, 844 aa, Artificial Sequence
  Synthetic polypeptide
MILDADYITEEGKPVIRLFKKENGEFKIEHDRTFRHYIYALLKDDSKIEEVKKITAERHGKIVRIVDAEKVEKKFLGRPITVWRLYFEHPQDVPTIREKIREHSAVVDIFEYDIPFAKRYLIDKGLIPMEGDEELKLLAFDIETLYHEGEEFGKGPIIMISYADEEEAKVITWKKIDLPYVEVVSSEREMIKRFLKIIREKDPDIIITYNGDSFDLPYLAKRAEKLGIKLTIGRDGSEPKMQRIGDMTAVEVKGRIHFDLYHVIRRTINLPTYTLEAVYEAIFGKPKEKVYADEIAKAWETGEGLERVAKYSMEDAKATYELGKEFFPMEAQLSRLVGQPLWDVSRSSTGNLVEWFLLRKAYERNELAPNKPDEREYERRLRESYAGGFVKEPEKGLWENIVSLDFRALYPSIIITHNVSPDTLNREGCRNYDVAPEVGHKFCKDFPGFIPSLLKRLLDERQKIKTKMKASQDPIEKIMLDYRQRAIKILANSYYGYYGYAKARWYCKECAESVTAWGREYIEFVWKELEEKFGFKVLYIDTDGLYATIPGGKSEEIKKKALEFVDYINAKLPGLLELEYEGFYKRGFFVTKKKYALIDEEGKIITRGLEIVRRDWSEIAKETQARVLEAILKHGNVEEAVRIVKEVTQKLSKYEIPPEKLAIYEQITRPLHEYKAIGPHVAVAKRLAAKGVKIKPGMVIGYIVLRGDGPISNRAILAEEYDPRKHKYDAEYYIENQVLPAVLRILEGFGYRKEDLRWQKTKQTGLTSWLNIKKSGTGGGGATVKFKYKGEEKEVDISKIKKVWRVGKMISFTYDEGGGKTGRGAVSEKDAPKELLQMLEKQKK

SEQ ID NO: 170 - DNA, 20 bp, Artificial Sequence
  Synthetic primer
ccaacatggcgaaatgctgt

SEQ ID NO: 171 - DNA, 20 bp, Artificial Sequence
  Synthetic primer
catcaacaacacggtcagcc

SEQ ID NO: 172 - DNA, 20 bp, Artificial Sequence
  Synthetic primer
cccacagttggtaggcatca

SEQ ID NO: 173 - DNA, 20 bp, Artificial Sequence
  Synthetic primer
ttgctcagcaacaagttggc

SEQ ID NO: 174 - DNA, 20 bp, Artificial Sequence
  Synthetic primer
tcatgttggacggatggctg

SEQ ID NO: 175 - DNA, 20 bp, Artificial Sequence
  Synthetic primer
cgggctgtcttcatcacctc

SEQ ID NO: 176 - DNA, 21 bp, Artificial Sequence
  Synthetic primer
accatgtgagacgctaatcca

SEQ ID NO: 177 - protein, 5 aa, Artificial Sequence
  Synthetic peptide
RHYIY

SEQ ID NO: 178 - protein, 5 aa, Artificial Sequence
  Synthetic peptide
QHYIY

SEQ ID NO: 179 - protein, 5 aa, Artificial Sequence
  Synthetic peptide
EHYIY

SEQ ID NO: 180 - protein, 5 aa, Artificial Sequence
  Synthetic peptide
EHYFY

SEQ ID NO: 181 - protein, 5 aa, Artificial Sequence
  Synthetic peptide
RHYFY

SEQ ID NO: 182 - protein, 5 aa, Artificial Sequence
  Synthetic peptide
  MISC_FEATURE (5)..(5): X is any neutral amino acid
WQKTX

SEQ ID NO: 183 - protein, 5 aa, Artificial Sequence
  Synthetic peptide
  MISC_FEATURE (1)..(1): X is any neutral amino acid
XQTGL

SEQ ID NO: 184 - protein, 5 aa, Artificial Sequence
  Synthetic peptide
  MISC_FEATURE (3)..(3): X is any neutral amino acid
KTXQT

SEQ ID NO: 185 - protein, 5 aa, Artificial Sequence
  Synthetic peptide
  MISC_FEATURE (5)..(5): X is any neutral amino acid
YQKTX

SEQ ID NO: 186 - protein, 5 aa, Artificial Sequence
  Synthetic peptide
  MISC_FEATURE (1)..(1): X is any neutral amino acid
XQVGL

SEQ ID NO: 187 - protein, 5 aa, Artificial Sequence
  Synthetic peptide
  MISC_FEATURE (3)..(3): X is any neutral amino acid
KTXQV

SEQ ID NO: 188 - protein, 5 aa, Artificial Sequence
  Synthetic peptide
  MISC_FEATURE (5)..(5): X is any neutroal amino acid
YQSSX

SEQ ID NO: 189 - protein, 5 aa, Artificial Sequence
  Synthetic peptide
  MISC_FEATURE (3)..(3): X is any neutral amino acid
SSXQT

SEQ ID NO: 190 - protein, 5 aa, Artificial Sequence
  Synthetic peptide
  MISC_FEATURE (5)..(5): X is any neutral amino acid
TGRVX

SEQ ID NO: 191 - protein, 5 aa, Artificial Sequence
  Synthetic peptide
  MISC_FEATURE (1)..(1): X is any neutral amino acid
XKSLL

SEQ ID NO: 192 - protein, 5 aa, Artificial Sequence
  Synthetic peptide
  MISC_FEATURE (3)..(3): X is any neutral amino acid
RVXKS

SEQ ID NO: 193 - protein, 5 aa, Artificial Sequence
  Synthetic peptide
  MISC_FEATURE (5)..(5): X is any neutral amino acid
TGRSX

SEQ ID NO: 194 - protein, 5 aa, Artificial Sequence
  Synthetic peptide
  MISC_FEATURE (1)..(1): X is any neutral amino acid
XRTLL

SEQ ID NO: 195 - protein, 5 aa, Artificial Sequence
  Synthetic peptide
  MISC_FEATURE (3)..(3): X is any neutral amino acid
RSXRT

SEQ ID NO: 196 - protein, 5 aa, Artificial Sequence
  Synthetic peptide
LDFRS

SEQ ID NO: 197 - protein, 5 aa, Artificial Sequence
  Synthetic peptide
FRSLY

SEQ ID NO: 198 - protein, 5 aa, Artificial Sequence
  Synthetic peptide
SLYPS

SEQ ID NO: 199 - protein, 5 aa, Artificial Sequence
  Synthetic peptide
  MISC_FEATURE (2)..(2): X is any amino acid other than P
RXYIY

SEQ ID NO: 200 - protein, 5 aa, Artificial Sequence
  Synthetic peptide
  MISC_FEATURE (2)..(2): X is any amino acid other than P
QXYIY

SEQ ID NO: 201 - protein, 5 aa, Artificial Sequence
  Synthetic peptide
  MISC_FEATURE (2)..(2): X is any amino acid other than P
EXYIY

SEQ ID NO: 202 - protein, 5 aa, Artificial Sequence
  Synthetic peptide
  MISC_FEATURE (2)..(2): X is any aminoa cid othr than P
EXYFY

SEQ ID NO: 203 - protein, 5 aa, Artificial Sequence
  Synthetic polypeptide
  MISC_FEATURE (2)..(2): X is any amino acid other than P
RXYFY

SEQ ID NO: 204 - protein, 5 aa, Artificial Sequence
  Synthetic peptide
  MISC_FEATURE (5)..(5): X is any neutral amino acid
WQKTX

SEQ ID NO: 205 - protein, 5 aa, Artificial Sequence
  Synthetic peptide
  MISC_FEATURE (5)..(5): X is any neutral amino acid
YQKTX

SEQ ID NO: 206 - protein, 5 aa, Artificial Sequence
  Synthetic peptide
  MISC_FEATURE (1)..(1): X is any neutral amino acid
XQTGL

SEQ ID NO: 207 - protein, 5 aa, Artificial Sequence
  Synthetic peptide
  MISC_FEATURE (1)..(1): X is any neutral amino acid
XQVGL

SEQ ID NO: 208 - protein, 5 aa, Artificial Sequence
  Synthetic peptide
  MISC_FEATURE (3)..(3): X is any neutral amino acid
KTXQT

SEQ ID NO: 209 - protein, 5 aa, Artificial Sequence
  Synthetic peptide
  MISC_FEATURE (3)..(3): X is any neutral amino acid
KTXQV

SEQ ID NO: 210 - protein, 5 aa, Artificial Sequence
  Synthetic peptide
  MISC_FEATURE (5)..(5): X is any neutral amino acid
YQSSX

SEQ ID NO: 211 - protein, 5 aa, Artificial Sequence
  Synthetic peptide
  MISC_FEATURE (3)..(3): X is any neutral amino acid
SSXQT

SEQ ID NO: 212 - protein, 5 aa, Artificial Sequence
  Synthetic peptide
  MISC_FEATURE (5)..(5): X is any neutral amino acid
TGRVX

SEQ ID NO: 213 - protein, 5 aa, Artificial Sequence
  Synthetic peptide
  MISC_FEATURE (1)..(1): X is any neutral amino acid
XKSLL

SEQ ID NO: 214 - protein, 5 aa, Artificial Sequence
  Synthetic peptide
  MISC_FEATURE (3)..(3): X is any neutral amino acid
RVXKS

SEQ ID NO: 215 - protein, 5 aa, Artificial Sequence
  Synthetic peptide
  MISC_FEATURE (5)..(5): X is any neutral amino acid
TGRSX

SEQ ID NO: 216 - protein, 5 aa, Artificial Sequence
  Synthetic peptide
  MISC_FEATURE (1)..(1): X is any neutral amino acid
XRTLL

SEQ ID NO: 217 - protein, 5 aa, Artificial Sequence
  Synthetic peptide
  MISC_FEATURE (3)..(3): X is any neutral amino acid
RSXRT

SEQ ID NO: 218 - protein, 10 aa, Artificial Sequence
  Synthetic polypeptide
  MISC_FEATURE (1)..(10): This sequence may encompass 6-10 residues"
HHHHHHHHHH

What is claimed is:

1. A thermophilic DNA polymerase comprising a family B polymerase N-terminal domain comprising a uracil-binding pocket and a family B polymerase catalytic domain, the family B polymerase N-terminal domain comprising a uracil-binding pocket having an amino acid sequence in which the position corresponding to position 36 of SEQ ID NO: 1 is any amino acid other than P, and the family B polymerase catalytic domain having an amino acid sequence in which the position corresponding to position 762 of SEQ ID NO: 1 is a neutral amino acid residue, wherein the thermophilic DNA polymerase comprises an amino acid sequence having at least 90%, 95%, 98%, or 99% identity to a sequence selected from SEQ ID NOs: 127, 135, 143, 149, 153, 155, and 157.

2. The thermophilic DNA polymerase of claim 1, wherein the position corresponding to position 36 of SEQ ID NO: 1 is selected from Q, N, H, S, T, Y, C, M, W, A, I, L, F, V, and G.

3. The thermophilic DNA polymerase of claim 1, wherein the position corresponding to position 36 of SEQ ID NO: 1 is H.

4. The thermophilic DNA polymerase of claim 1, wherein the position corresponding to position 762 of SEQ ID NO: 1 is selected from Q, N, H, S, T, Y, C, M, W, A, I, L, F, V, P, and G.

5. The thermophilic DNA polymerase of claim 4, wherein the position corresponding to position 762 of SEQ ID NO: 1 is selected from Q and N.

6. The thermophilic DNA polymerase of claim 1, comprising a family B polymerase N-terminal domain comprising a uracil-binding pocket and a family B polymerase catalytic domain, wherein the family B polymerase N-terminal domain comprising a uracil-binding pocket comprises a consecutive amino acid sequence selected from RX$^1$YIY (SEQ ID NO: 199), Q X$^1$YIY (SEQ ID NO: 200), E X$^1$YIY (SEQ ID NO: 201), E X$^1$YFY (SEQ ID NO: 202), or R X$^1$YFY (SEQ ID NO: 203), wherein X$^1$ is any amino acid other than P; and wherein the family B polymerase catalytic domain comprises a consecutive amino acid sequence selected from WQKTX$^2$ (SEQ ID NO: 204), X$^2$QTGL (SEQ ID NO: 206), KTX$^2$QT (SEQ ID NO: 208), YQKTX$^2$ (SEQ ID NO: 205), X$^2$QVGL (SEQ ID NO: 207), KTX$^2$QV (SEQ ID NO: 209), YQSSX$^2$ (SEQ ID NO: 210), X$^2$QTGL (SEQ ID NO: 206), SSX$^2$QT (SEQ ID NO: 211), TGRVX$^2$ (SEQ ID NO: 212), X$^2$KSLL (SEQ ID NO: 213), RVX$^2$KS (SEQ ID NO: 214), TGRSX$^2$ (SEQ ID NO: 215), X$^2$RTLL (SEQ ID NO: 216), or RSX$^2$RT (SEQ ID NO: 217), wherein X$^2$ is a neutral amino acid residue;

wherein X$^1$ is within 50 residues of the N-terminus of the family B polymerase N-terminal domain comprising a uracil-binding pocket; and wherein X$^2$ is within 20 residues of the C-terminus of the family B polymerase catalytic domain.

7. The thermophilic DNA polymerase of claim 1, wherein the family B polymerase catalytic domain has at least 80%, 85%, 90%, 95%, 98%, 99%, or 100% identity to the family B polymerase catalytic domain sequence of a sequence selected from SEQ ID NOs: 6 to 10, 15 to 18, 25, 26, 33, 34, 37, 38, 41, 42, and 45 to 48.

8. The thermophilic DNA polymerase of claim 7, wherein the neutral amino acid is selected from Q and N.

9. The thermophilic DNA polymerase of claim 1, wherein the family B polymerase N-terminal domain comprising a uracil-binding pocket has at least 80%, 85%, 90%, 95%, 98%, 99%, or 100% identity to a sequence selected from SEQ ID NOs: 115 to 121 and 162 to 168, wherein X$^1$ is any amino acid other than P.

10. The thermophilic DNA polymerase of claim 9, wherein X$^1$ is selected from Q, N, H, S, T, Y, C, M, W, A, I, L, F, V, and G.

11. The thermophilic DNA polymerase of claim 9, wherein X$^1$ is H.

12. The thermophilic DNA polymerase of claim 1, wherein the amino acid residue at the position of the amino acid sequence that corresponds to position 408 of SEQ ID NO: 1 is a serine.

13. The thermophilic DNA polymerase of claim 1, which comprises a sequence non-specific double-stranded DNA-binding domain.

14. The thermophilic DNA polymerase of claim 13, wherein the sequence non-specific double-stranded DNA-binding domain comprises an amino acid sequence having at least 75%, 80%, 85%, 90%, 95%, 98%, 99%, or 100% identity to a sequence selected from SEQ ID NOs: 53 to 62.

15. The thermophilic DNA polymerase of claim 13, wherein the sequence non-specific double-stranded DNA-binding domain is an Sso7d, Sac7d, or Sac7e domain.

16. A method of in vitro nucleic acid synthesis comprising contacting at least one primer and at least one template with the thermophilic DNA polymerase of claim 1 in the presence of at least one dNTP.

17. The method of claim 16, wherein the thermophilic DNA polymerase is initially bound to a thermolabile inhibitor and the method comprises denaturing the inhibitor.

18. The method of claim 16, further comprising amplification of the template.

19. The method of claim 18, wherein the amplification comprises PCR.

* * * * *